United States Patent 11,098,302 (IDENTIFICATION OF POLYNUCLEOTIDES ASSOCIATED WITH A SAMPLE) - sequence listing, part 124

SEQ ID NO: 430023 - DNA, 511 bp, Homo sapiens
  misc_feature: GZ8MTXP02JNGZM.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcactgggtcaggcagtccccatcgagaggtctagagtggctggggaagacatatttcattgtccaaacacgtaggaaatacaaaatttatgcaccatctgttgagagtcgactgaacaatacaaacgtagacacatacgaagaaaccagttacctccctgcagctagaccttctgtgacctccgacggacgacgggtgtataagttacgtgtaggaacgacggccccataacg

SEQ ID NO: 430024 - DNA, 536 bp, Homo sapiens
  misc_feature: GZ8MTXP02GWCHW.19.71.G05.1.454.CMB.2.raw
  modified_base (240)..(240): a, c, t, g, unknown or other
  modified_base (315)..(315): a, c, t, g, unknown or other
  modified_base (345)..(345): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctctaggctgctcatttacnggcatctacccgggatcccccggggtcccngaccgattcagtggcagcgggtctgggacagatttcactctcacatcagcacgcctgcaggctagagatgtgactagtttatattgtacaaataattattaattataacgtttcgtaggtacgtttaccggacgtaaacgggtaccgtaaaggtcggtaataagtacgaagacggtaactggtaggctacg

SEQ ID NO: 430025 - DNA, 507 bp, Homo sapiens
  misc_feature: GZ8MTXP02G3F8Z.19.71.G05.1.454.CMB.2.raw
  modified_base (428)..(428): a, c, t, g, unknown or other
  modified_base (445)..(445): a, c, t, g, unknown or other
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcacgtgggtcaggcagtccccatcgagaggtctagagtggctggggaaggacatatttcatgtccaaacacgtaggaatacaaattatgcacatctgttagagagtacgactagaacaatacaaacgtagaacacatacgaagaaccagttcncctgcagctcgacctcncgtcgaccgtccgacggacgacgggtgtataagttacgtacgtaggacgacgccccagtacg

SEQ ID NO: 430026 - DNA, 678 bp, Homo sapiens
  misc_feature: GZ8MTXP02IE807.19.71.G05.1.454.CMB.2.raw
  modified_base (246)..(246): a, c, t, g, unknown or other
  modified_base (340)..(340): a, c, t, g, unknown or other
  modified_base (402)..(402): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccaccgatacgaactgacaagtccagccacaatcttttaanacacgttaccaaacaataacgaaactacttagtcttacggaaccagacgaagacgaacgaaggacacgcctacgagctgctactaagtttacgnggactacgtaccgtaacccgggtacgtcccggggtcccctagaccgtactcgaggtcggacncgggtcgggttacgtacggggacctagttactttaccacctacctaccaacctactacgaacgcctacgtccgtacgacgacggtacgtagaaagagtagtaggtacgttaagtttaagttaagttacgtaactaaactaaattaaatttaattaacgttacgttacggttacggtacggttaccggtaaccggtaaacgggtaaacggtaaacggtaacggtaacgtaacgtaacgtaacggtaacgtaacgtacggtacggtacgtacgtaccg

SEQ ID NO: 430027 - DNA, 581 bp, Homo sapiens
  misc_feature: GZ8MTXP02I3A7E.19.71.G05.1.454.CMB.2.raw
  modified_base (238)..(238): a, c, t, g, unknown or other
  modified_base (314)..(314): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacgnggcatccgtaccggacgtccgggtcccctagaccgtattcgaggtcggcgcggcgggtcgtagggactagtactttcactctaccactatcagcacgcctgcaggctagaaagtgtggtcgtacttagtttattagttcgtaactaaactaattaatttagttaactacgttcggttacggtacgtttaccggaaccgtaaacggggtaacctaagggtacgtaataacgtaacgaacgtaacgtaacgtggtacggtacgtacgac

SEQ ID NO: 430028 - DNA, 532 bp, Homo sapiens
  misc_feature: GZ8MTXP02I54HM.19.71.G05.1.454.CMB.2.raw
  modified_base (238)..(238): a, c, t, g, unknown or other
  modified_base (359)..(359): a, c, t, g, unknown or other
  modified_base (391)..(391): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactactagcttggtaccagcagagaccaggacagcctcctaggctgctcatttactgggcatctacccgggaatcccggggtcccctgaccgattcagtggcnggcgggtctggggacagatttcactctcaccntcagcagcctgcagctgaagatgtggctagtttatattgtacaaactaattattattattacttcggttacggtacgttcggaccgtaaagggaccaaggggtggaatagtaacgaagaacgtaactggtacggctcgacc

SEQ ID NO: 430029 - DNA, 610 bp, Homo sapiens
  misc_feature: GZ8MTXP02FL6QI.19.71.G05.1.454.CMB.2.raw
  modified_base (234)..(234): a, c, t, g, unknown or other
  modified_base (242)..(242): a, c, t, g, unknown or other
  modified_base (244)..(244): a, c, t, g, unknown or other
  modified_base (246)..(246): a, c, t, g, unknown or other
  modified_base (252)..(252): a, c, t, g, unknown or other
  modified_base (254)..(255): a, c, t, g, unknown or other
  modified_base (297)..(297): a, c, t, g, unknown or other
  modified_base (351)..(351): a, c, t, g, unknown or other
  modified_base (423)..(423): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcaccatcaactgcaagtccagccacatctttanacatcaanananaaactntnntgacagcagagacagacagcctctaggctgctctatttacgnggcactccgtaccgggacgtcccggggtccccctgaccgtattcgaggtggcgnggcgggtcgtagggactagtacttcactcctaccacctatacgacgcacgcctgaccgagggactagaaagngttggtacggtacttaagttttaattaagttacgtaacaaaataaattaatttaattaacgttacgttacggttacgggtaccggtttaccgggaaccgtaaacggggtaaaccgtaaaggggtagtaaacgttaaacgtaacgtaacggtaacggtaaacggtacggtacggtacggtacgtaccg

SEQ ID NO: 430030 - DNA, 517 bp, Homo sapiens
  misc_feature: GZ8MTXP02JV3I5.19.71.G05.1.454.CMB.2.raw
  modified_base (239)..(239): a, c, t, g, unknown or other
  modified_base (366)..(366): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgaccccagtctccagactccctggctgtgtctctgggcgagcgggccaccatcaactgcaagtccagccacaatctttttanacagttccaacaatgaaaactactagcttggtaccagcagagaccaggacagcctcctaggctgctcatttactggggcatcgtaaccccgggaatccggggtccccctgacccgattccagtggcnggcgggtctggggacagatttcactctcacccatcagcagccctgcaggctgaagatgtggctagttattattgtacaatatattatatacttcgtgtactttcggcaagggaccaaggtcggatatcgagacgaactgtcggactcgacc

SEQ ID NO: 430031 - DNA, 588 bp, Homo sapiens
  misc_feature: GZ8MTXP02GNF9K.19.71.G05.1.454.CMB.2.raw
  modified_base (237)..(237): a, c, t, g, unknown or other
  modified_base (313)..(313): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacgnggctacgtccgtaccggacgtcccggggtcccctacgaccgtatcgagtcggacgcgggtcgggtcgtagggactagtactttcactctacacatcagcacgcctgacgagcgtagaagtagtggtgtacttagtttattattacgtaactaaactaattaatttaattaacttacgttacggttacggtaccggttacggaaccggtaaacgggaaccgtaagggtacgtaatagtaacgtaacgaacgtaacgtggtacggtacgtacgtacg

SEQ ID NO: 430032 - DNA, 587 bp, Homo sapiens
  misc_feature: GZ8MTXP02HLMG0.19.71.G05.1.454.CMB.2.raw
  modified_base (233)..(233): a, c, t, g, unknown or other
  modified_base (240)..(240): a, c, t, g, unknown or other
  modified_base (248)..(248): a, c, t, g, unknown or other
  modified_base (252)..(252): a, c, t, g, unknown or other
  modified_base (260)..(260): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacggatacgacgtcgactaaggcagccanatcttanacatcaanatanaactatanctgtacagcagagacgagacacgcctccgtacgctcgtctctacttacgtcgacgtactaccgtaccggtacggtaccggtccccgtcgaccgtacgtacgtacgtcggcgcggtcgggtcgtcggacgtacgtacgttactactctaccaccactacgacgacgacgtcgtcgcgacgacgtagagtagtagtcgtagtagttattagttacgtactaactaattattattacttacgttacgtacggtacggttacggtacgtaacggtaacggtacgtacgtacgtacgtaacgtacgacgtacgtagtacgtacgtacgtacg

SEQ ID NO: 430033 - DNA, 511 bp, Homo sapiens
  misc_feature: GZ8MTXP02GPT9J.19.71.G05.1.454.CMB.2.raw
  modified_base (237)..(237): a, c, t, g, unknown or other
  modified_base (312)..(312): a, c, t, g, unknown or other
  modified_base (344)..(344): a, c, t, g, unknown or other
  modified_base (353)..(353): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacnggcatctaccggatccggggtcccctgaccgnttcagtgcngcgggtctgggacagatttcactctcaccatcagcagcctgcagctgaagatgtggctagtttatatgtacaacatattattatacttcgtaggtacgtttcggacctaaaggggcctaaaggtcggatagtcgaagaccgtaactgtaggctagacc

SEQ ID NO: 430034 - DNA, 686 bp, Homo sapiens
  misc_feature: GZ8MTXP02I4TD8.19.71.G05.1.454.CMB.2.raw
  modified_base (238)..(238): a, c, t, g, unknown or other
  modified_base (248)..(248): a, c, t, g, unknown or other
  modified_base (253)..(253): a, c, t, g, unknown or other
  modified_base (310)..(310): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcgaactgacaagtccagccacaatctttanactatacaanaatanaaactatagctagacagcagacgacgagacacgcctcgtagctgactactattacgngggactacgtaccgtaacccgggacgtcccggggtccctacgaccgtacttacgaggtcggcgacgggtcggggtcgtaggggactagttactttaccgaccttcctacccaacctactaccgaacgaccgtacgccgtacgaccgagggacgtaggaaacgtagttaggtacggtacgtttaagttttaatttacgttacgtaacctaaacttaaatttaatttaaatttaacttaaccgtttacggttacgggttaccggttaccggggtaaccggtaaaacggggtaaccggtaaaggggttacggtaaacgttaacgtaacgtaacggtaaaccggtaacggttcgggtacggtaccgtacggacctaaccg

SEQ ID NO: 430035 - DNA, 501 bp, Homo sapiens
  misc_feature: GZ8MTXP02FWF38.19.71.G05.1.454.CMB.2.raw
  modified_base (453)..(453): a, c, t, g, unknown or other
  modified_base (461)..(461): a, c, t, g, unknown or other
  modified_base (468)..(468): a, c, t, g, unknown or other
  modified_base (491)..(491): a, c, t, g, unknown or other
  modified_base (493)..(493): a, c, t, g, unknown or other
  modified_base (496)..(501): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgacccgattcagtggcagcgggtctgggacagatttcactctcaccatcagcagcctgcaggctgaagatgtggcctagtttatattgtacaacaattattattatacttcgtggtacgtttcggcaaaggggaccaaaggtgaatatcgagacgaactgtgctgcaccatctgtcttcatcctccgcatcngacacganacgtacnggacgcgggctggacaggcgaananagnnnnnn

SEQ ID NO: 430036 - DNA, 584 bp, Homo sapiens
  misc_feature: GZ8MTXP02FHJSN.19.71.G05.1.454.CMB.2.raw
  modified_base (313)..(313): a, c, t, g, unknown or other
  modified_base (353)..(353): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcaccgatacgaactgcaagtccagccacaatctttatacagttcaacaatgaaaactacttagcttggtaccagcagagaccaggacagctcctaggctgctcatttacgnggcatcgaccggactccgggtcccctgaccgatcagtgcnggcgggtctgggacagtactttcactctacaccatcagcacgcctcgacgacgacgtagaagagtagtaggtacgtagtttaagtttattacgttactaaactaaattaattaattaattaacgttacgttacggtacggttaccggtaccggtaaacgggtaaaccggtaaacggtacggtaagtaacgtaacgtaacgaacgtaacgtacggtacggtacgtacgtacg

SEQ ID NO: 430037 - DNA, 569 bp, Homo sapiens
  misc_feature: GZ8MTXP02GJ199.19.71.G05.1.454.CMB.2.raw
  modified_base (238)..(238): a, c, t, g, unknown or other
  modified_base (313)..(313): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttacgnggctatccgtaacccggggaatcccggggtccccctgaccgtattcagtcggcaggcggggtctggggaccaggtactttcactctcaaccatacagcagccctagccgaggctagaaagtagtggtggtactaggttttattagttcgtactaaataattaatttattatacttcggtacggtacgttcggaccgaaagggtacctaagggtacgaattactaacgaagtaacgaacgttggacgactacggacc

SEQ ID NO: 430038 - DNA, 516 bp, Homo sapiens
  misc_feature: GZ8MTXP02JVOWT.19.71.G05.1.454.CMB.2.raw
  modified_base (238)..(238): a, c, t, g, unknown or other
  modified_base (311)..(311): a, c, t, g, unknown or other
  modified_base (415)..(415): a, c, t, g, unknown or other
  modified_base (420)..(420): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggaccagcagagaccaggacagcctctaggctgctcatttacnggcatcgtacccgggaatccggggtccccctgaccgattcagtggcaggcgggtctggggacagatttcactctcaccatcagcagcctgcaggctagaaagtntgtgntagtttattatgtacaataatattattatacttgtacgtacgttcgacgaaggtacgtaaggtacgatataacgacgacgacgtgacgtcgacgac

SEQ ID NO: 430039 - DNA, 522 bp, Homo sapiens
  misc_feature: GZ8MTXP02GAR92.19.71.G05.1.454.CMB.2.raw
  modified_base (234)..(234): a, c, t, g, unknown or other
  modified_base (309)..(309): a, c, t, g, unknown or other
  modified_base (350)..(350): a, c, t, g, unknown or other
  modified_base (405)..(405): a, c, t, g, unknown or other
  modified_base (411)..(411): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactacttagcttggaccagcagagaccaggacagcctcctaggctgctcatttacnggcatctaccggaatccggggcccctgaccgattcagtgcnggcgggtctgggacagtatttcactctcaccatcagcagcctgcaggctgaaagntgtggntagtttatatgtacaaataattattattatactttcgtaggtacgtttcggaccgaaagggacctaaagggtacggataacgtcgaagaacgtaaactggtacggctgacc

SEQ ID NO: 430040 - DNA, 489 bp, Homo sapiens
  misc_feature: GZ8MTXP02IUN6V.19.71.G05.1.454.CMB.2.raw
  modified_base (233)..(233): a, c, t, g, unknown or other
  modified_base (300)..(300): a, c, t, g, unknown or other
  modified_base (306)..(306): a, c, t, g, unknown or other
  modified_base (340)..(340): a, c, t, g, unknown or other
  modified_base (366)..(366): a, c, t, g, unknown or other
  modified_base (464)..(464): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtcagccacaatctttanacagttccaacaatgaaaactacttagcttggtaccagcagagaccaggacagcctctaggctgctnatttcngggcatcctacccgggatccggggtcctgaccgnttcagtgcagcgggtctgggacagtnttcactctcacatcagcagcctgcagcagagatgtggctagtttattatgtacaacattattattatactgtgtacgtcggacaggaccaggtcgatntacaagacgaactgtagctcgctac

SEQ ID NO: 430041 - DNA, 587 bp, Homo sapiens
  misc_feature: GZ8MTXP02GC0W9.19.71.G05.1.454.CMB.2.raw
  modified_base (237)..(237): a, c, t, g, unknown or other
  modified_base (249)..(249): a, c, t, g, unknown or other
  modified_base (307)..(307): a, c, t, g, unknown or other
  modified_base (348)..(348): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgcaagtccagccacaatctttanacagttccaaanaatgaaaactctagcttggaccagcagagaccagacagcctcagctgctcatttacgnggcatcgaccggagtccggtcccctgaccgtatcgagtgcnggcggtcagggacagtattcactctacacatacagcacgcctcgacgacgacgtagaaagtagtaggtaggtacgttagtttaagtttaagttacgttaactaaacttaaattaaatttaatttaacttacgtttacggttacggttacggttacggtaccggtaaacgggtaaacggtaacggtaacggtaagtaacgtaacgtaacgtaacgtacgtaggtacggtacgtacgtacg

SEQ ID NO: 430042 - DNA, 607 bp, Homo sapiens
  misc_feature: GZ8MTXP02IXTBA.19.71.G05.1.454.CMB.2.raw
  modified_base (249)..(249): a, c, t, g, unknown or other
  modified_base (261)..(261): a, c, t, g, unknown or other
  modified_base (266)..(266): a, c, t, g, unknown or other
  modified_base (276)..(276): a, c, t, g, unknown or other
  modified_base (325)..(325): a, c, t, g, unknown or other
  modified_base (387)..(387): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtggggcgaggccgggccacgatacgaactgacaagtccagccactaattctttanactactaccaanaatanaaactactanctacgacagacagacgacagacacgcctcgagctgctactagtttacgnggactacgtaccgtaacccgggtacgtcccggggtcccctacgaccgtatcgaggtcggcgnggggtccggtcgtacggactagttcttaccactcctacaccatacgacgcacgccgtcgcgacgacgagagtagtgtagtagttagttattatagtactaactaattaattaattattacgttacgtacggtacggttacggtaacggtaacggtaacggtaacggtacgtacgtacgtaacgtaacgtaacggtacgtacggtacggtacgtacgtacg

SEQ ID NO: 430043 - DNA, 516 bp, Homo sapiens
  misc_feature: GZ8MTXP02IVJF4.19.71.G05.1.454.CMB.2.raw
  modified_base (238)..(238): a, c, t, g, unknown or other
  modified_base (360)..(360): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactacttagcttggtaccagcagagaccaggacagcctcctaggctgctcatttactgggcatcctacccgggaatccggggtcccctgaccgattcagtgcnggcggtctggggacaggatttcactctcaccatcagcagccctgcagctagaagatgtggctagtttattatgtacaataatattattatacttcgtagtacgttcggacaaagggacctaaggtacggatatcgagacgaactgtacggctgacc

SEQ ID NO: 430044 - DNA, 599 bp, Homo sapiens
  misc_feature: GZ8MTXP02HBPGH.19.71.G05.1.454.CMB.2.raw
  modified_base (239)..(239): a, c, t, g, unknown or other
  modified_base (314)..(314): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttanacagttccaacaatgaaaactacttagcttggtaccagcagagaccaggacagcctctaggctgctcatttacgnggcactaccgtaccggacgtccgggtcccctacgaccgtatcgagtcggcgcggtcgggtcgtagggactagtactttccactctacaccatcacgcgacgccgtcgacgacgacgtagaagtagtagtaggtacgtagtttagttagttacgtactaactaattaattaatttacttacgttacgttacggttacggttacggtaccggtaaacggtaacggtaacggtacggtaacgtacgtaacgtaacgtaacgtaacgtacggtacggtacgtacgtacg

SEQ ID NO: 430045 - DNA, 567 bp, Homo sapiens
  misc_feature: GZ8MTXP02HZMCF.19.71.G05.1.454.CMB.2.raw
  modified_base (225)..(225): a, c, t, g, unknown or other
  modified_base (234)..(234): a, c, t, g, unknown or other
  modified_base (306)..(306): a, c, t, g, unknown or other
  modified_base (535)..(535): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcagccggccaccatcaactgcaagtccagccanaatctttanacagttccaaacaatgaaaactctagcttggaccagcagagaccaggacagcctctagctgctcatttacgngcatcgaaccggacgtccgggtcctacgacctatcgaggtggcgaggcgggtcgtagggaactagtacttccactcctaccaaccatcacgctacgctagacgacggctagaaagtagtggtacggtacgttaagtttattagttagtaactaaaataattaatttaattaacttacgttacggtacggtaccgttacggacgaaacgggtacgtaaaggtagactaanacgaagaacgtaacgtgacggtctacgacacg

SEQ ID NO: 430046 - DNA, 587 bp, Homo sapiens
  misc_feature: GZ8MTXP02JB0NX.19.71.G05.1.454.CMB.2.raw
  modified_base (229)..(229): a, c, t, g, unknown or other
  modified_base (240)..(240): a, c, t, g, unknown or other
  modified_base (314)..(314): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccanaattctttaanacagttaccaacaatagaaaactctagcttggaccagcagagaccaggacagcctccgtagctgctcatttacnggcacgtccgtaaccccggggatcccccggggtccctgaacccgtattcgaggtcggcgaggtcgggtcgtaggggactagtactttccactctacacctatcagcacgcctgacgaggctagaagagtggtgacttaggtttattagttagtactaaataatttattaattacgttaacgttcggttaggtacgttccggaacggtaacgggtaccgtaaaagggtggtaaattaacgtacgaaggtaacgtaacgtggtacggtctaacgg

SEQ ID NO: 430047 - DNA, 520 bp, Homo sapiens
  misc_feature: GZ8MTXP02IAUCI.19.71.G05.1.454.CMB.2.raw
  modified_base (238)..(238): a, c, t, g, unknown or other
  modified_base (302)..(302): a, c, t, g, unknown or other
  modified_base (313)..(313): a, c, t, g, unknown or other
  modified_base (359)..(359): a, c, t, g, unknown or other
  modified_base (415)..(415): a, c, t, g, unknown or other
  modified_base (418)..(418): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanacagttccaacaatgaaaactacttagcttggtaccagcagagaccaggacagcctcctaggcngctcatttacnggcatcctacccgggaatccggggtcccctgaccgattcagtggcnggcgggtctggggacaggatttcactctcaccatcagcagcctgcaggctgaaagntgnggtctagtttattattgtcaataatatttaatatacttcgtaggtacgttcggactaaagggacctaagggtcgataactcgagaacgacgtgtggctagcc

SEQ ID NO: 430048 - DNA, 611 bp, Homo sapiens
  misc_feature: GZ8MTXP02FT0OO.19.71.G05.1.454.CMB.2.raw
  modified_base (230)..(230): a, c, t, g, unknown or other
  modified_base (240)..(240): a, c, t, g, unknown or other
  modified_base (252)..(252): a, c, t, g, unknown or other
  modified_base (317)..(317): a, c, t, g, unknown or other
  modified_base (427)..(427): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccaanaatcttttanacagttccaaanaatagaaaactacttagcttggtaaccagacagagaccaggacagcctcaggctgctcatttacngggcatccgtacccgggaatcccggggtcctgacccgtattcgagtcggcaggcggggtctggggacagtactttcactctacaccatcaagcacgccctgacgacgggntaggaagagttggtaggacttaagttttatttagttagtaccaaaattaattaatttaattaagttaaccgtttggtacggttaacggtttccggaaccgtaaaacggggaacccgtaaagggttcggtaaacttagtacgaaaggtaaccgtaaacgtcgggtagtaccgtggacctaaaccg

SEQ ID NO: 430049 - DNA, 511 bp, Homo sapiens
  misc_feature: GZ8MTXP02GITJF.19.71.G05.1.454.CMB.2.raw
  modified_base (227)..(227): a, c, t, g, unknown or other
  modified_base (237)..(237): a, c, t, g, unknown or other
  modified_base (312)..(312): a, c, t, g, unknown or other
  modified_base (358)..(358): a, c, t, g, unknown or other
  modified_base (412)..(412): a, c, t, g, unknown or other
  modified_base (485)..(485): a, c, t, g, unknown or other
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccanaatcttttanacagttccaacaatgaaaactacttagcttggtaccagcagagaccaggacagcctcctaggctgctcatttacngggcatctaccggggaatccggggtcccctgaccgattcagtggcngcgggtctggggacagatttcactctcaccatcagcagcctgcaggctgaaagntgtgctagtttatatgtacaatattattattatacttgtacggtacgttcggacgaaggacgtaaggtgatanaacgacgacgacgtagtgcgtacgcg

SEQ ID NO: 430050 - DNA, 526 bp, Homo sapiens
  misc_feature: GZ8MTXP02H4CRF.19.71.G05.1.454.CMB.2.raw
  modified_base (238)..(238): a, c, t, g, unknown or other
  modified_base (313)..(313): a, c, t, g, unknown or other
  modified_base (360)..(360): a, c, t, g, unknown or other
  modified_base (519)..(519): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatcctacccgggaatccggggtcccctgaccgattcagtggcnggcgggtctggggacagtatttcactctcaccatcagcagcctgcaggctgaaagatgtgggtctaggttttattaagttgttacaaactaattaattatttatactttcgtaggacgtttcggaccgtaaagggacaaggtgatatcgagacgactgnggctgac

SEQ ID NO: 430051 - DNA, 654 bp, Homo sapiens
  misc_feature: GZ8MTXP02HMUUO.19.71.G05.1.454.CMB.2.raw
  modified_base (239)..(239): a, c, t, g, unknown or other
  modified_base (249)..(249): a, c, t, g, unknown or other
  modified_base (253)..(253): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatcttttanacataccaanatanaaactactagcttaggaccagcagacgaccaggacacgcctcgtaggctgctactatttacgtggactacgtaccgtaacccggggtaacgtccccggggtccccctacggaccgtattacgaggtcggcgacgggtccgggtcgtacggggactagttactttccgaccttcctaccaaccctataccgacgaccgacgtcccgtagacgacggtactagaaaggtgttggtacggtacttagttttattagttagtactaaataatttagtttaatttaacttacgtttacggtacggttaccgtttaccgggtaaccgtaaacggggtaaccgtaaagggttacggtaacgttacgtaacgtaacgtaacgtaacgtacggtacggtacgtacgtacg

SEQ ID NO: 430052 - DNA, 523 bp, Homo sapiens
  misc_feature: GZ8MTXP02JRZ2P.19.71.G05.1.454.CMB.2.raw
  modified_base (322)..(322): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatccgagaggtctagagtggctgggaaggacatatttcatgtaccaanacgtggaactacaaattatgcaccatctgttgagtagtcgactgaacaatacaacgtagacacatacgaacgaacagttcctaccctgcagctcgacctcgtcgtgaccgtccgaggacgtacgggtgtatacttacgtgtaggagacggaccccagtacgacaagtcgaacccacgtaccgtctcgtcggtcacgttacg

SEQ ID NO: 430053 - DNA, 527 bp, Homo sapiens
  misc_feature: GZ8MTXP02H4U3S.19.71.G05.1.454.CMB.2.raw
  modified_base (237)..(237): a, c, t, g, unknown or other
  modified_base (247)..(247): a, c, t, g, unknown or other
  modified_base (251)..(251): a, c, t, g, unknown or other
  modified_base (302)..(302): a, c, t, g, unknown or other
  modified_base (346)..(346): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacataccaanatanaaactatagctagacagcagagacagacacgcctcagctgctctatttacnggacatcgtaccggagtccgggtcccctgacctatcagtcgacnggcgggtcgtagggacagtacttacactctacaccatacagcacgcctgacaggctagaaagtagtggtggtacttaagtttattagttagtacaaactaatattaattatacgttcgtaggtacgttacgacgaacgggactaggtacgatataacgacgaacgacgtgtcgtctacgcg

SEQ ID NO: 430054 - DNA, 565 bp, Homo sapiens
  misc_feature: GZ8MTXP02HPKQ8.19.71.G05.1.454.CMB.2.raw
  modified_base (239)..(239): a, c, t, g, unknown or other
  modified_base (371)..(371): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgaggccgggccaccatcaactgacaagtccagccacaattcttttanacagttaccaacaatagaaaactctagcttagaccagcagagaccaggacagcctctaggctgctcattacggggcatcgaacccgggaatcccggggtcctgacccgtattcgaggtggccaggccgggtntgggacagtattcactctacacatcagcagcctgcgagctagaaagtgtggtggtacttagttttattagttgtactaaataattattattaataccgtttagtacggtacgtttaccgggaccgtaaacggggacctaaagggttacggaacttagtacgaaggtacgtaaacgttggtagcctagactaacc

SEQ ID NO: 430055 - DNA, 642 bp, Homo sapiens
  misc_feature: GZ8MTXP02GS25L.19.71.G05.1.454.CMB.2.raw
  modified_base (196)..(196): a, c, t, g, unknown or other
  modified_base (226)..(226): a, c, t, g, unknown or other
  modified_base (234)..(234): a, c, t, g, unknown or other
  modified_base (238)..(238): a, c, t, g, unknown or other
  modified_base (243)..(243): a, c, t, g, unknown or other
  modified_base (252)..(252): a, c, t, g, unknown or other
  modified_base (255)..(255): a, c, t, g, unknown or other
  modified_base (262)..(262): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgnggcggcacagtacgactgacagtcagccanatctttanactntacanatataactntanctgacancagacacgagacacgtcctacgtacgtctcgtctacttacgtttacgcggtactacgtacccggtaacccgggtacgttcccggggtacccctacgtaccgtactcgaggtacggtcggcggtcgggtcggtacggtacgtacgtacgttactactactacctactactacgacgacgacgtccgtcgacgacgtacgtacgtaagtagtaggtacggttacgttagtttagtttaagttacgttaactaaacttaattaatttaattaacgttacgttacgttacggttacggttacggtaccggtaacggtaacggtaacggtacgtaacgtacgtaacgtaacgtaacgtaacggtacggtacggtacgtacgtacg

SEQ ID NO: 430056 - DNA, 519 bp, Homo sapiens
  misc_feature: GZ8MTXP02JA6IH.19.71.G05.1.454.CMB.2.raw
  modified_base (225)..(225): a, c, t, g, unknown or other
  modified_base (235)..(235): a, c, t, g, unknown or other
  modified_base (309)..(309): a, c, t, g, unknown or other
  modified_base (419)..(419): a, c, t, g, unknown or other
  modified_base (513)..(513): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccanaatcttttanacagttccaacaatgaaaactactagcttggtaccagcagagaccaggacagcctcctaggctgctcatttacnggcatcgtacccggggaatccggggtcccctgacccgtattccgagtcggcaggtcgggtctaggggaccagtatttcactctcaccatcagcagcctgcagctgaaagntgtggctagtttattattgacaactaattattattatacttcgtgacgttcgccgaaaggaccaggtacggatataacgagacgaactgtcgcngtaacc

SEQ ID NO: 430057 - DNA, 503 bp, Homo sapiens
  misc_feature: GZ8MTXP02GCQKA.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatctccggggacagagtcgctagcgacagtgttgcttggcactggggtcaggcagtccccatcgagaggtctagagtggctggggaagacatatttcatgtccacacgtggaaatacaaattatgacaccatctgttgagagtcgactgacaatcaaacgtagacacatacgaagaaccagttcctaccctgcagctagacctctcgtcgactcccgaggacacgggtagtatattaacgtgtaggaacgacggaccccagtacgaac

SEQ ID NO: 430058 - DNA, 547 bp, Homo sapiens
  misc_feature: GZ8MTXP02F2NCY.19.71.G05.1.454.CMB.2.raw
  modified_base (238)..(238): a, c, t, g, unknown or other
  modified_base (310)..(310): a, c, t, g, unknown or other
  modified_base (363)..(363): a, c, t, g, unknown or other
  modified_base (448)..(448): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttccaacaatgaaaactctagcttggaccagcagagaccaggacagcctcctaggctgctcatttacngggcatccgtacccggggaatcccggggtccccctgacccgattcgagtggcnggtcgggtcttgggacagtactttcactctcaccatcagcagcctgcgaggctagaagatggtggctaggtttatattcgcaaanattattattatacttcgtacgtagtttcggacctaaaggggacctaagggttcggaattagtaacgaaggtaacgtaacgtggtacggtacgtacgacc

SEQ ID NO: 430059 - DNA, 611 bp, Homo sapiens
  misc_feature: GZ8MTXP02HSCT4.19.71.G05.1.454.CMB.2.raw
  modified_base (240)..(240): a, c, t, g, unknown or other
  modified_base (322)..(322): a, c, t, g, unknown or other
  modified_base (398)..(398): a, c, t, g, unknown or other
  modified_base (425)..(425): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaagtccagccacaattcttttanacagttaccaaactaatagaaaacttacttagcttaggtaccagcagagaccaggacagcctcctaggctgctctatttacngggactatcccgtacccggggaatcccggggtcctcggaccgtattcgaggtggcaggcggggtctggggacagtntttcgacttctcacatcagcacgtccncgacgagctagaagtagtgtaggtacttagtttattagttacgtaactaaattaattaatttaattaacttacgttcggttacggtaccggttacggaaccggtaaacgggtaacgtaaagggtacggtaacttaacgtaacgaacgtaacggtaacgttcggtacgtaccgtacgtacctaaccg

SEQ ID NO: 430060 - DNA, 530 bp, Homo sapiens
  misc_feature: GZ8MTXP02ISJ4G.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatatttcatcgtaccacgtacgtaggaaactaacgtaaattatgaccacctatctgttagagtagtacgactagaacaatacaacgtagacacaatacgaacaccacgttcctccgtgcagctacgactcgtacgtcgactccggacggacgtacgggtactattagttaacgtagtacggaacgacggacccctagtaacgaacg

SEQ ID NO: 430061 - DNA, 630 bp, Homo sapiens
  misc_feature: GZ8MTXP02IOEIW.19.71.G05.1.454.CMB.2.raw
  modified_base (242)..(242): a, c, t, g, unknown or other
  modified_base (257)..(257): a, c, t, g, unknown or other
  modified_base (308)..(308): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttaanacataccaacaatanaaactactagctgacagcagagacagacagcctcagctgctctatttacgnggcataccgtaaccgggaacgtcccgggtcccctagaccgtattcgagtcggcgcgggtcgggtcgtaggactagtactttaccactcctacaaccatacacgacgacgtaccgtacgacgacggacgtagaagtaagtaggtaggtacgttaagtttaagtttaagtttacgttaactaaactaaacttaaatttaaatttaacttaacgttacgttacggttacggttaccggtaaccggtaaaacgggtaaacggtaaacggtaacggtaagtaacgtaacgtaacgaacgtaaacgtacggtacggtacgtacgtacg

SEQ ID NO: 430062 - DNA, 519 bp, Homo sapiens
  misc_feature: GZ8MTXP02ITV24.19.71.G05.1.454.CMB.2.raw
tcagtactctcgtgcacgaccggtgctcgatttagtgtcgtcgcaagagagagggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatctccggggacagagtcgctagcgacagtgttgcttggcacgtgggtcaggcagtccccatcgagaggtctagagtggctgggaaggacatatttcatgtaccaacacgtggaactacaattatgacaccatctgttgagagtcgactgaacaatacaacgtagacacatacgaacgaacctacgttacctccctgacacgctacgaccttctgtacgacctccgaggacgacggtgtagtattacgtgtaggaacgacggaccccatacgacatcgaaccaccgtcgtctcgtgtcgactag

SEQ ID NO: 430063 - DNA, 608 bp, Homo sapiens
  misc_feature: GZ8MTXP02H16GR.19.71.G05.1.454.CMB.2.raw
  modified_base (240)..(240): a, c, t, g, unknown or other
  modified_base (250)..(250): a, c, t, g, unknown or other
  modified_base (263)..(263): a, c, t, g, unknown or other
  modified_base (309)..(309): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgacaagtccagccacaatcttttanacataccaanatagaaactatanctagacagcagacacagacacgcctcgagctgctactagtttacgnggactagtaccgtaacccggggacgtcccggggtaccccctaggaccgtattcgaggtcggactacggtccgggtctacgggactagtactttccacctctaccacctatcacgacgacgcgtcgacgacgacgtagagtagtagtagtagtagttattagttagtactaactaaattaattaattaacttaacgttacgttacggtacggttaccggtaaccggtaaacggtaaacggtaacggtacggtaagtaacgtaacgtaacgtaacgtaacgtacgtacggtacgtacgacg

SEQ ID NO: 430064 - DNA, 589 bp, Homo sapiens
  misc_feature: GZ8MTXP02GD6K1.19.71.G05.1.454.CMB.2.raw
  modified_base (239)..(239): a, c, t, g, unknown or other
  modified_base (248)..(248): a, c, t, g, unknown or other
  modified_base (252)..(252): a, c, t, g, unknown or other
  modified_base (262)..(262): a, c, t, g, unknown or other
  modified_base (270)..(270): a, c, t, g, unknown or other
  modified_base (275)..(275): a, c, t, g, unknown or other
  modified_base (305)..(305): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacgatcgaactgacaagtccagccacaatctttanacatacaanatanaaactactanctagacancaganacagacacgcctctagctgctctattacgnggacactccgtaccgggacgtccccggggtccctagaccgtattcgaggtcggcgaggcgggtcgtagggacagtacttccactctcaccatcagcacgcctcgacgacgacgtagaagtagtaggtaggtacgttagtttaatttattacgttactaaactaaattaattaattaattaacgttacggttacggtaccggttaccggtaccggtaacgggtaacggtaacggtaaggtaacgtaacgtacgtaacgtacgtaacgtacggtacggtacgtacg

SEQ ID NO: 430065 - DNA, 603 bp, Homo sapiens
  misc_feature: GZ8MTXP02HBK7K.19.71.G05.1.454.CMB.2.raw
  modified_base (227)..(227): a, c, t, g, unknown or other
  modified_base (235)..(235): a, c, t, g, unknown or other
  modified_base (244)..(244): a, c, t, g, unknown or other
  modified_base (248)..(248): a, c, t, g, unknown or other
  modified_base (265)..(265): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagcagccanatctttanacatacaanatanaactactatctgtacanacagagacagacacgcctctacgctcgctctacttacgtcggcactaccgtaccggtacgtccggtccccgtcgaccgtactacgtacgtcggcgcggtcgggtcggtcggacgtacgtacgttactactactaccacctactacgacgacgacgaccgtcgacgacgacgtagagtagtgtggtacgtagtttagttattacgtactaactaattaattattacttacgttacgttacggtacggttaccggtaaccggtaaacgggtaaacggtaacggtacggtaacgtaacgtaacgtaacgtaacgtaacgtacggtacggtacgtacgtacg

SEQ ID NO: 430066 - DNA, 614 bp, Homo sapiens
  misc_feature: GZ8MTXP02JQI4R.19.71.G05.1.454.CMB.2.raw
  modified_base (233)..(233): a, c, t, g, unknown or other
  modified_base (236)..(236): a, c, t, g, unknown or other
  modified_base (241)..(241): a, c, t, g, unknown or other
  modified_base (245)..(245): a, c, t, g, unknown or other
  modified_base (253)..(253): a, c, t, g, unknown or other
  modified_base (298)..(298): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagcacatctttanacntacanatanaactctanctgacagcagagacagacacgcctcgtagctgctactatttacgnggctacgtccgtacccgggagtccgggtcccctcgaccgtatcgaggtcggcgcgggtcgggtcgtacgggactagtactttccaccttcctacctaacctacgtacgacgacgacgtaccgtcgacgacgtacgtagtaagtagtaggtaggtacgttagtttagtttagttacgttaactaactaaattaatttaattaacgttaacgttacggttacggttacggttaccggtaaccggtaaacgggtaacggtaacggtacggtaagtacgtaacgtaacgtaacgtacgtacggtacggtacgtacgtacg

SEQ ID NO: 430067 - DNA, 513 bp, Homo sapiens
  misc_feature: GZ8MTXP02H6Z0W.19.71.G05.1.454.CMB.2.raw
  modified_base (322)..(322): a, c, t, g, unknown or other
  modified_base (453)..(453): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcactggcaggcagtccccatcgagaggtctaggagtggctaggggaagacatatttcatgtccaaacncgtaggaaatacaaaattatgcaccatctgttgagagtcgatgaacaatacaaacgtagacacatacgaaagaacctagttacctcctgacagctgtaacctcgtgcgaccgtcccgaggaccgacgggtntatattactgagtacgacgccccatacgacatcgccactcgtctcgtcggtcgacttacg

SEQ ID NO: 430068 - DNA, 507 bp, Homo sapiens
  misc_feature: GZ8MTXP02FZJ9N.19.71.G05.1.454.CMB.2.raw
  modified_base (354)..(354): a, c, t, g, unknown or other
  modified_base (359)..(359): a, c, t, g, unknown or other
  modified_base (498)..(498): a, c, t, g, unknown or other
  modified_base (500)..(500): a, c, t, g, unknown or other
  modified_base (502)..(507): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgacccgattcagtggcagcgggtctgggacagatttcactctcaccatcagcagcctgcaggctgaagatgtggcctagtttatattgtcaanaattnttattatacttcgtggacgtttcggacctaaaggggaccaaggtggaatagtcagaccgtaatggtgctgacaccattctgtcttcatccttcccgctatctgacacgagacgtctgacgcgggctggccaaggcgaananannnnnn

SEQ ID NO: 430069 - DNA, 662 bp, Homo sapiens
  misc_feature: GZ8MTXP02GO0EC.19.71.G05.1.454.CMB.2.raw
  modified_base (241)..(241): a, c, t, g, unknown or other
  modified_base (255)..(255): a, c, t, g, unknown or other
  modified_base (339)..(339): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccaacaatcttttaanactagttaccaaanaatagaaaactactagtcttacggaaccagacaagaacgaaccgaggacacgccctaccgtaggctgacctactacgtttacgngggactacgttacccggtaacccggggaacgtccccggggtacctacggaaccgtattcgaggtcggacgtacgggtccggggtctaggggaactagtacttcacttcctacacctatacgagcacgcctcgacgacgacgagaagtagtagtaggtacgttagtttattattagtaactaaactaaattaattaatttaattacgttacgttacggtaacggttaccggtaaccggtaaacgggtaaacggtaaacggtacggtaacgtaacgtaacgtaacgtaaacgtaacgtacggtacggtacgtacgtacgtaaccg

SEQ ID NO: 430070 - DNA, 591 bp, Homo sapiens
  misc_feature: GZ8MTXP02FTE97.19.71.G05.1.454.CMB.2.raw
  modified_base (240)..(240): a, c, t, g, unknown or other
  modified_base (314)..(314): a, c, t, g, unknown or other
  modified_base (354)..(354): a, c, t, g, unknown or other
  modified_base (386)..(386): a, c, t, g, unknown or other
  modified_base (396)..(396): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttanacagttcaacaatgaaaactacttagcttggtaccagcagagaccaggacagcctcctaggctgctcatttacnggcatctaccgggatccggggcccctgaccgatcagtgcngcgggtctgggacagtatttcactctcaccancacgcacgcncgacgacgacgtagaagagtaggtggtagtagtttagtttaagttacgtactaaactaaattaatttaatttaactttacgttacggttacggttacggttaccggtaaccggtaaacgggtaaacggtaaacggtaacggtaagttaacgtaacgtaacgtaacggtaaacgtacggtacggtacgtacgtacg

SEQ ID NO: 430071 - DNA, 607 bp, Homo sapiens
  misc_feature: GZ8MTXP02FYFOA.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagtgttgcttggcacgtgggtcaggcacgtccccagtcgaggaggtctaggaggtggcgtaggggaaggactattatttcagttcgtaccaaacacggttaggaaataactaaaatttatgacacctatctagttagaagtagtcgactagaacaaagtacaaacgtagaactaacaagtacgaaaacgaacctaacgttcctacctacgacacgtacctacgaaccctcgtacgtacggtacccgtacccgggaacggtaaccggtaccggggttagttaagttaacgttaacggtaggtaacgggaaccggtaccgggaccccctaagtaaaccg

SEQ ID NO: 430072 - DNA, 510 bp, Homo sapiens
  misc_feature: GZ8MTXP02GNNM5.19.71.G05.1.454.CMB.2.raw
  modified_base (323)..(323): a, c, t, g, unknown or other
  modified_base (445)..(445): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaaggacagtatttcatgtaccaanacgtggaactacaaattatgacaccatctgttgagagtcgatgacatcaacgtagacacatacgaacgaacagttcctccctgacagctcgacctctgtcgaccgtccgaggacgacgggtntatattactggtaggaagtacgaccccagtacgacatcgccacctcgtctcgtcggtcgcttaag

SEQ ID NO: 430073 - DNA, 524 bp, Homo sapiens
  misc_feature: GZ8MTXP02H30IF.19.71.G05.1.454.CMB.2.raw
  modified_base (441)..(441): a, c, t, g, unknown or other
  modified_base (485)..(485): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgcccatcgtccggggacagacgtcgctagcgacagtgttgcttggcacgtgggtcaggcacgtccccatcgagagtctagagtggctagggaagactatatttcattgtccaaacgacgtaggaaataacaaattatgacaaccatctggttagagagtcgactagaacatacaaacgtagacacaatacgaaagacctagttccncctgcagctacgacctcagtcgactacccggagaccgacgggtntataagttacgagtacgggaaagtccggaccctagaacg

SEQ ID NO: 430074 - DNA, 617 bp, Homo sapiens
  misc_feature: GZ8MTXP02IOYF1.19.71.G05.1.454.CMB.2.raw
  modified_base (229)..(229): a, c, t, g, unknown or other
  modified_base (237)..(237): a, c, t, g, unknown or other
  modified_base (245)..(245): a, c, t, g, unknown or other
  modified_base (247)..(247): a, c, t, g, unknown or other
  modified_base (249)..(249): a, c, t, g, unknown or other
  modified_base (254)..(254): a, c, t, g, unknown or other
  modified_base (256)..(257): a, c, t, g, unknown or other
  modified_base (263)..(263): a, c, t, g, unknown or other
  modified_base (277)..(277): a, c, t, g, unknown or other
  modified_base (287)..(287): a, c, t, g, unknown or other
  modified_base (300)..(300): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctcctggctgtgtctcgtgggcgaggcggccacatcaactgcaagtccagccanatctttanacatcaanananaactntnntgacancagacacagacacncctcgagctnctactatttacgnggactacgtaccgtacccggtacgtcccgggtccccgtacgaccgtacttcgagtcggacgcgggtcgggtcgtacgggactagtacttcactctacacctactacacgcacgtcctagacgacggacgtagaagtgtcggtacggtacgtttagtttaattacgttacgtaactaaacttaatttaaagtttaatttaacgttacgtttacggttacgggttaccggttaccgggaccggtaaacgggtacggtaacgggtacgtaagttaacgtaacgtaaacggtaacgtacggtggtacggtacgtacgtacc

SEQ ID NO: 430075 - DNA, 626 bp, Homo sapiens
  misc_feature: GZ8MTXP02JY3PR.19.71.G05.1.454.CMB.2.raw
  modified_base (225)..(225): a, c, t, g, unknown or other
  modified_base (234)..(234): a, c, t, g, unknown or other
  modified_base (243)..(243): a, c, t, g, unknown or other
  modified_base (247)..(247): a, c, t, g, unknown or other
  modified_base (301)..(301): a, c, t, g, unknown or other
  modified_base (362)..(362): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccanaatctttanacatacaanatanaaactctagctgacagcagacgacagacacgcctcgtagctgctctatttacgnggcacgtaccgtaacccgggacgtcccggggtaccccctagaccgtattcgaggtcggcgngggtcgggtcgtggggactagtactttccactcctaccacctactcacgcacgccgtggacgacggtacgtaggaagtagtggtacggtacttagttttacttagttacgtactaaactaatttatttaatttacgttacgtttacggttacgggttaccggttaccgggtaaccggtaaacggggtaaccggtaaaggggttacggtaattaacgtaaccgtaacggtaaccggtaacggttaggtacggtacgtacggaccg

SEQ ID NO: 430076 - DNA, 517 bp, Homo sapiens
  misc_feature: GZ8MTXP02GPY92.19.71.G05.1.454.CMB.2.raw
  modified_base (240)..(240): a, c, t, g, unknown or other
  modified_base (315)..(315): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgacaagtccagccacaatctttanacagttccaaacaatgaaaactacttagcttaggaccagcagagaccaggacagcctctaggctgctcatttacnggcatctacccggaatccggggtacccctgaccgattcgagtggcaggcggtctggggacagtactttcactctcaccatcagcacgcctgcagcgagagagtgtggtgtagttattattagtacaataatattattatactcgtagtacgtcgtacgacggaacgacgtaggtagtataagacgacgacgagtgtcgcgac

SEQ ID NO: 430077 - DNA, 559 bp, Homo sapiens
  misc_feature: GZ8MTXP02HFWLI.19.71.G05.1.454.CMB.2.raw
  modified_base (237)..(237): a, c, t, g, unknown or other
  modified_base (342)..(342): a, c, t, g, unknown or other
  modified_base (359)..(359): a, c, t, g, unknown or other
  modified_base (418)..(418): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactacttagcttggtaccagcagagaccaggacagcctctaggctgctcatttactgggcatctacccgggaatccggggtccccngaccgattcagtcggcngcgggtctgggacaggtatttcactctcacccatcagcagccctgcaggctagaaacgntggtggctagtttattaatgtacaactaattattattagtacttcgtggtacgtttcggaccgtaaaggggaccctaagggtacggatttaaacgaacgtaggtaacccggtaaacttggtacgggacccttaggaacccg

SEQ ID NO: 430078 - DNA, 514 bp, Homo sapiens
  misc_feature: GZ8MTXP02GEFTL.19.71.G05.1.454.CMB.2.raw
  modified_base (233)..(233): a, c, t, g, unknown or other
  modified_base (408)..(408): a, c, t, g, unknown or other
  modified_base (503)..(503): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctctaggctgctcatttactgggcatctaccgggatccgggtcctgaccgattcagtgcagcgggtctgggacagatttcactctcaccatcagcagcctgcaggctagaagatggtcggntagtttattattgacaaataattattattatacttcggtgtaacgttcggaccgtaaagggacctaaggtcggatatacgaagaacgaacttggngactacgacac

SEQ ID NO: 430079 - DNA, 509 bp, Homo sapiens
  misc_feature: GZ8MTXP02FPJ1L.19.71.G05.1.454.CMB.2.raw
  modified_base (228)..(228): a, c, t, g, unknown or other
  modified_base (237)..(237): a, c, t, g, unknown or other
  modified_base (311)..(311): a, c, t, g, unknown or other
  modified_base (354)..(354): a, c, t, g, unknown or other
  modified_base (407)..(407): a, c, t, g, unknown or other
  modified_base (410)..(410): a, c, t, g, unknown or other
  modified_base (428)..(428): a, c, t, g, unknown or other
  modified_base (483)..(483): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaacaatgaaaactacttagcttggtaccagcagagaccaggacagcctctaggctgctcatttacnggcatcaccgggaatccggggtcccctgaccgattcagtggcnggcgggtctgggacagatttcactctcaccatcagcagcctgcagctgaaagntgngctagtttatatgacaanaattatatatacttgtggtacgttcggaccaaaggggtaccaagggttagattancgaagacgaaactgtacggctagacc

SEQ ID NO: 430080 - DNA, 584 bp, Homo sapiens
  misc_feature: GZ8MTXP02GJHLZ.19.71.G05.1.454.CMB.2.raw
  modified_base (225)..(225): a, c, t, g, unknown or other
  modified_base (234)..(234): a, c, t, g, unknown or other
  modified_base (243)..(243): a, c, t, g, unknown or other
  modified_base (247)..(247): a, c, t, g, unknown or other
  modified_base (256)..(256): a, c, t, g, unknown or other
  modified_base (300)..(300): a, c, t, g, unknown or other
  modified_base (361)..(361): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacatcaactgcaagtccagccanaatctttanacatacaanatanaaactctanctgacagcagacgaccagacagcctcgagctgctctatttacgnggctacgtaccgtaaccgggaacgttcccggggtacccctagaccgtattccgagtcggcngggcgggtctaggggactagtatttccacttctacaaccatcagcacgcctgacgaggctagaaagtgtgtaggtacttaagtttattattacgtaactaaactaattatttaagttaacttacgttacggtacggtaccgtttacggaaccgtaaacgggtaccgtaagggtcgtaacttaagtaacgaagtaaccgtaacgttggtacgtacgtacgtacg

SEQ ID NO: 430081 - DNA, 543 bp, Homo sapiens
  misc_feature: GZ8MTXP02FWU3F.19.71.G05.1.454.CMB.2.raw
  modified_base (367)..(367): a, c, t, g, unknown or other
  modified_base (495)..(495): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatctccggggacagagtcgctagcgacagtgttgcttggcacgtgggtcaggcacgtccccagtcgagaggtctagagtggctggggaagacatatttcatgtccaacacgtagaaatacaaatttancgacacatctagttgagagtcgactgaacaatacaaacgtagaacacatacgaaacgaaacctacgttcctaccctagacagactcgaccttcgtagtcgaccgtacccgacggaccgtaacggggtnttaacgtaagttacgtacggtaggaaacgtaccggacccccagtaacg

SEQ ID NO: 430082 - DNA, 531 bp, Homo sapiens
  misc_feature: GZ8MTXP02H8XKX.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtcctgtctccttcctcttcttcctgcccgtgctgggcctcccacaaggtgtcctgtcacaagtacagctgcagcagtcaggtccaggactggtgaagccctgcagacccctctccgctcaccctgtcgccatctccggggacagagtcgctagcgacagtgttgcttggcacgtgggtcaggcagtccccatcgagaggtctagagtggctggggaagacatatttcatcgtccaagacgtagaaataacaaattatgacaccatctgttagagtagtacgactagaacatacaaacgtagacacatacgaagaacagttactaccgtgacagctagacctcgtagtcgacctacccggacggaccgtacgggtataacgtaagttacgtagtacggaacgacggaccccaagtaaccg

SEQ ID NO: 430083 - DNA, 583 bp, Homo sapiens
  misc_feature: GZ8MTXP02JGLA6.19.71.G05.1.454.CMB.2.raw
  modified_base (236)..(236): a, c, t, g, unknown or other
  modified_base (247)..(247): a, c, t, g, unknown or other
  modified_base (251)..(251): a, c, t, g, unknown or other
  modified_base (310)..(310): a, c, t, g, unknown or other
  modified_base (367)..(367): a, c, t, g, unknown or other
  modified_base (411)..(411): a, c, t, g, unknown or other
  modified_base (414)..(414): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacatcaactgcaagtccagccacaatctttanacagtaccaanatanaaactatagcttgaccagacagacgaccagacagcctcgtaggctgctactatttacgnggactactccgtacccgggaacgtcccggggtcccctagaccgtattcgagtcggcnggtcggtcgtagggacagtactttcactctacaccatcagcacnccncgacgacgacgtagagtagtgtagtacgtagtttagttattagtactaactaattaattattacttacgttacgttacggtacggttacggtaccggtaacggtaacggtaacggtacggtacgtacgtaacgtaacgtaacgtaacgtacgtacggtacgtacgtacg

SEQ ID NO: 430084 - DNA, 524 bp, Homo sapiens
  misc_feature: GZ8MTXP02IA1S6.19.71.G05.1.454.CMB.2.raw
  modified_base (320)..(320): a, c, t, g, unknown or other
  modified_base (352)..(352): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcactggtcaggcagtccccatcgagaggtctagagtggctgggaaggacatatttcatgtaccaanacgtgaaatacaaattatgacaccatctgttnagagtcgactgacaatacaacgtagacacatacgaagactagtctcctgacagctgacctctgtcgacgtacccgaggacgacgggtagtactagttactaggtacggaacgtacgacccccgataacgactaactcgaaccctaccgtcgtactcgtcggtcgtacttacg

SEQ ID NO: 430085 - DNA, 515 bp, Homo sapiens
  misc_feature: GZ8MTXP02GIJM5.19.71.G05.1.454.CMB.2.raw
  modified_base (346)..(346): a, c, t, g, unknown or other
  modified_base (390)..(390): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagaggtctagagtggctggggaaggacatatttcattgtaccaacacgtaggaaactacaaattangacaccatctgttgagtagtcgactgacaatcaaacgtagacanatacgaagaaccagttctcctgacagctcgacctctgtgacctccgaggacgacgggtgtatattactagtaggaagacggaccccatacgacatcgaaccacctcgtctcgtggtcgacttacg

SEQ ID NO: 430086 - DNA, 642 bp, Homo sapiens
  misc_feature: GZ8MTXP02HX10Q.19.71.G05.1.454.CMB.2.raw
  modified_base (240)..(240): a, c, t, g, unknown or other
  modified_base (257)..(257): a, c, t, g, unknown or other
  modified_base (317)..(317): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcagccgggccaccgatcaactgacaagtccagccacaattcttttaanactataccaaataatanaaaactctagcttagaccagcagacgaccagacagcctacgtagctgctactatttacgnggactacgtccgtaacccgggtacgtccccggggtcctacggaccgtacttcgaggtcggacgagggtccgggtcgtgggactagttactttacaccttcctaccacctatccgacgcacgtccgtagacgacggctaggaagtagttggtacgtacgtttagtttattagttacgtaactaaactaatttaagtttacttaacgtttacgtttacggtacggttaccggttaccggaaccggtaaacgggtaacggtaacgggttacgtaacttaacgtacgaacggtaacgtaacgtcggtacggtaccgtacgtacctaacg

SEQ ID NO: 430087 - DNA, 617 bp, Homo sapiens
  misc_feature: GZ8MTXP02HS7ON.19.71.G05.1.454.CMB.2.raw
  modified_base (242)..(242): a, c, t, g, unknown or other
  modified_base (254)..(254): a, c, t, g, unknown or other
  modified_base (266)..(266): a, c, t, g, unknown or other
  modified_base (300)..(300): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaaactgacaaagtccaagccaacaattcttttaanacagtaccaaanaatagaaaactntagctagacagcagagacagacagcctcgagctnctctattacgtgctactacgtaccggtaacgtaccggtccgtaccgacgtactacgagtgacgacgcggtcgtacggacgagtattactactactacaccactacacgacgacgacgtacgacgacgacgtacgtaagtagtaggtacggtacgttaagtttaatttagttagttaactaaactaaattaaatttaaatttaattaacgtttacgttacggttacggttacggtaccggtaaacggtaaacggtaaacggtaacgtaacgtaacgtacgtaacgtaacgtaacgtacgtacgtacgtacgtacgacg

SEQ ID NO: 430088 - DNA, 507 bp, Homo sapiens
  misc_feature: GZ8MTXP02F71GV.19.71.G05.1.454.CMB.2.raw
  modified_base (235)..(235): a, c, t, g, unknown or other
  modified_base (246)..(246): a, c, t, g, unknown or other
  modified_base (311)..(311): a, c, t, g, unknown or other
  modified_base (368)..(368): a, c, t, g, unknown or other
  modified_base (415)..(415): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatctttanacagttccaanaatagaaaactactagcttggtaccagcagagaccaggacagcctcctaggctgctctatttacngggcatccgtacccgggaatcccggggtcctcgaccgattcagtggcaggcgggtcngggacagtattcactctcaccatcagcagcctgcagctagaagatgnggctagtttatattgacaataattattatatacttcgtagtacgttcgacgtaaaggacaaaggtgaatatacgaagacgaatgtgctgcac

SEQ ID NO: 430089 - DNA, 570 bp, Homo sapiens
  misc_feature: GZ8MTXP02I8921.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcacgtgggtcaggcacgtccccatcgagaggtctagagtggcgtaggggaagactatagtttcattcgtccaactacgtaggaaatactaaattatgacacctatctagttgagagtcgactgaactaatacaaacgtagacacatacgaaacgaacctagttcctaccctgacacgtcttacgacccttcgtcggtacgtaccgtaccccggaaggtacccgtaacgggggtattaaacgttaacgttaacgtacggtaaggaaacgtaccgggtacccccaagtaaaccgg

SEQ ID NO: 430090 - DNA, 608 bp, Homo sapiens
  misc_feature: GZ8MTXP02G43LH.19.71.G05.1.454.CMB.2.raw
  modified_base (234)..(234): a, c, t, g, unknown or other
  modified_base (243)..(243): a, c, t, g, unknown or other
  modified_base (252)..(252): a, c, t, g, unknown or other
  modified_base (265)..(265): a, c, t, g, unknown or other
  modified_base (314)..(314): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggcatcgtgatgacccagtctccagactccctggctgtgtctcgtgggcgaggcgggcctacgatacgaactcgactaagtccagccanaatctttanacatacaanatacaaactctancttagacagcagacgacaggacacgcctacgagctgctactatttacgnggactacgtaccgtaccgggacgtccgggtcccctagaccgtatacgagtcggacgcggtcgggtcggtacggacgacgtacgttactactactacaccactacgacgacgacgccgtcgacgacgacgtacgaagtagtacggtacgtacgttagtttacgttagttacgtacgtaactaattaattaattaacttacgttacgttacggtacgttacggtacggtaacggtaacggtaacggtacgtacgtacgtaacgtacgtaacgtacgtacgtacgtacgtacgtacg

SEQ ID NO: 430091 - DNA, 543 bp, Homo sapiens
  misc_feature: GZ8MTXP02FO4F2.19.71.G05.1.454.CMB.2.raw
  modified_base (235)..(235): a, c, t, g, unknown or other
  modified_base (311)..(311): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctctaggctgcctcatttacngggcatccgtacccgggaatcccggggtcctcgaccgattcagtggcaggcggggtctggggacagtactttcactctcaccatcagcagctgcaggctagaagatgtggctagtttattattagtaccaaatatatttaattataacgttcgtaggtacgttcggacgaaacgggaccaaagggtcgactagtacgaagtaaccgaaacgttggtaggactcgactaaccg

SEQ ID NO: 430092 - DNA, 514 bp, Homo sapiens
  misc_feature: GZ8MTXP02F4FO7.19.71.G05.1.454.CMB.2.raw
  modified_base (476)..(476): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctggggaagacatatttcattgtccaaacacgtaggaatacaaattatgacaccatctgttgagagtcgactagacaatcaaacgtagacacatacgaaagaaccagttacctcccgtgcagctcgacctcgtgtcgacctcccgaggaccgacgggtntataagttactggtacggaacgacggaccccagtaacg

SEQ ID NO: 430093 - DNA, 520 bp, Homo sapiens
  misc_feature: GZ8MTXP02JR54S.19.71.G05.1.454.CMB.2.raw
  modified_base (234)..(234): a, c, t, g, unknown or other
  modified_base (245)..(245): a, c, t, g, unknown or other
  modified_base (309)..(309): a, c, t, g, unknown or other
  modified_base (510)..(510): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaanaatagaaaactacttagcttggtaccagcagagaccaggacagcctctaggctgctcatttacngggcatctacccgggatccggggtcctcgaccgattcagtgcagcgggtctggggactagatttcgactctcaccatcagcagcctgcaggctagaagagtgtggactagtttattagttgtacaactaattaattattatacttcgtaggtacgttcggacgaaggtaccgaaggtggactatacgaagacgaacgtggngctcgactac

SEQ ID NO: 430094 - DNA, 510 bp, Homo sapiens
  misc_feature: GZ8MTXP02G26BE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcacgtgggtcaggcacgtccccatcgagaggtctagagtggctgggaaggacatatttcatgtccaaacacgtaggaaatacaaagttatcgacacctatctagtgagagtcgatagacgaatacaaagtagaacacaatacgaagaacctagtctaccctgacagctgacctcgtgtcgactccgacggacgacggtgtataagttacgagtacggaagacggcccagtaacg

SEQ ID NO: 430095 - DNA, 539 bp, Homo sapiens
  misc_feature: GZ8MTXP02I3UHO.19.71.G05.1.454.CMB.2.raw
  modified_base (238)..(238): a, c, t, g, unknown or other
  modified_base (360)..(360): a, c, t, g, unknown or other
  modified_base (418)..(418): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttanacagttccaaacaatagaaaactacttagcttggtaccagcagagaccagacagcctctaggctgctcatttacgtggcatctacccgggaatcccggggtcccctgaccgattcagtggcnggcgggtctggggacagtactttcactctcaccatcagcagcctgcaggctagaaagntggtaggtctagttttattattagtaccaaataattattattatacttcggtagacgttcggacctaaaggggaccaaggtaggattagaaccgaagtaacgaaactgtcggactcggacc

SEQ ID NO: 430096 - DNA, 508 bp, Homo sapiens
  misc_feature: GZ8MTXP02GINN1.19.71.G05.1.454.CMB.2.raw
  modified_base (235)..(235): a, c, t, g, unknown or other
  modified_base (310)..(310): a, c, t, g, unknown or other
  modified_base (414)..(414): a, c, t, g, unknown or other
  modified_base (417)..(417): a, c, t, g, unknown or other
  modified_base (438)..(438): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccacaatctttanacagttccaacaatagaaaactacttagcttggtaccagcagagaccaggacagcctctaggctgctcatttacngggcatcgtacccgggaatcccggggtcctgacccgattcagtggcaggcggggtctggggacagtatttcactctcaccatcagcagcctgcaggctgaaagntgnggctagtttatattgactaanaattattattatacttgtggtacgttcggacctaagggacaggtgatatcaagacgaactgtagctgcac

SEQ ID NO: 430097 - DNA, 535 bp, Homo sapiens
  misc_feature: GZ8MTXP02F5JRU.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctggggaagacatatttcatgtccaacacgtaggaaatacaaattatgacaccatctagttgagagtcgactgaacaaatacaaacgtacgaacacaagtaccgaaaggaaacctagttcctcctgacagctagacctctcgtcgacctacccggaggaccgacgggttgtaacttaagttacgtcggtaggtaacgaccggtacccccagttaaccgg

SEQ ID NO: 430098 - DNA, 503 bp, Homo sapiens
  misc_feature: GZ8MTXP02I9C01.19.71.G05.1.454.CMB.2.raw
  modified_base (243)..(243): a, c, t, g, unknown or other
  modified_base (256)..(256): a, c, t, g, unknown or other
  modified_base (319)..(319): a, c, t, g, unknown or other
  modified_base (389)..(389): a, c, t, g, unknown or other
  modified_base (403)..(404): a, c, t, g, unknown or other
  modified_base (412)..(412): a, c, t, g, unknown or other
  modified_base (416)..(416): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccacaattctttanacagttaccaaanaatagaaaactctagctaggtaccagcagagaccaggacacgcctcgagctgctcatttacgnggcatccaccggggatcccccggggtcctgaccgattcgagtgcaggcggtctgggacagtattcactcncaccatcagcagcnncagcagangtgngatagttatatatacaatattattatatacgtgtagtacgtacgacgaacggacgtagtgataacgtacgagacgagtcgacgctag

SEQ ID NO: 430099 - DNA, 621 bp, Homo sapiens
  misc_feature: GZ8MTXP02FOLSX.19.71.G05.1.454.CMB.2.raw
  modified_base (226)..(226): a, c, t, g, unknown or other
  modified_base (237)..(237): a, c, t, g, unknown or other
  modified_base (249)..(249): a, c, t, g, unknown or other
  modified_base (254)..(254): a, c, t, g, unknown or other
  modified_base (313)..(313): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttaanacagttaccaanaatanaaactactagtctagaccagcagacgaccagacagcctcgtaggctgctactattacgngggctacgtaccgtaacccgggaagtccccggggtcctaccggaccgtatacgaggtcggcgagggtccggggtcgtaggggactagtactttcactctaccacctatcgagcacgccgtcgacgacggctagaagtagtggtacgtacgttaagtttatttagttacgtaactaaataatttaatttaattaacttacgtttacggtacggtaccggttacggtaccgtaaacggggtaaccgtaaacgggtacggtaactacgtacgaaggtaacgtaacgtacggtacgtacgtacgacctaacg

SEQ ID NO: 430100 - DNA, 658 bp, Homo sapiens
  misc_feature: GZ8MTXP02HLLL2.19.71.G05.1.454.CMB.2.raw
  modified_base (306)..(306): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagnggtctagagtggctggggaatgactattattcagtcgtaccaaacgtacggtaagtaaactaaactaaatttagacgaccaacctattacgttggttagaaggtacgtacgtacgtaacgaactaactaaacgtaaacggtaaacgaaccaactaacgtaaccggaaaaccgaacccttaacgttccctacccgtacgacctacggtaccgtaccttaaccgttcgtacggtacccgtaacccggttaacccggaacggtaaccgggtaccgggttaattaaaccgtttaaccggtttaacggttacgggtaaacgggtaaaacccggaccccggtaaaccccctaaaacgg

SEQ ID NO: 430101 - DNA, 569 bp, Homo sapiens
  misc_feature: GZ8MTXP02JHV53.19.71.G05.1.454.CMB.2.raw
  modified_base (226)..(226): a, c, t, g, unknown or other
  modified_base (237)..(237): a, c, t, g, unknown or other
  modified_base (242)..(242): a, c, t, g, unknown or other
  modified_base (246)..(246): a, c, t, g, unknown or other
  modified_base (252)..(252): a, c, t, g, unknown or other
  modified_base (255)..(255): a, c, t, g, unknown or other
  modified_base (266)..(266): a, c, t, g, unknown or other
  modified_base (295)..(295): a, c, t, g, unknown or other
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccaccatcgactgacaagtccagccanaatctttaacntcaanatanaaactntantgacagcaganacagacagcctcagctgctctatttacgnggctataccgtaccggaacgtcccggggtcccctagacctactacgaggtggacgagggtcgggtactagggactagtactttcactcctacacctatcacgcgacgccgtcgacgacgacgtagaagagtagtagtagtagtttattattagtactaactaattaattaatttaattacgttacgttacggtacggttacggtacgtaacggtaacggtaacggtacggtaagtacgtaacgaacgaacgtacgtagtacgtacgtacgtacg

SEQ ID NO: 430102 - DNA, 514 bp, Homo sapiens
  misc_feature: GZ8MTXP02F67G5.19.71.G05.1.454.CMB.2.raw
  modified_base (237)..(237): a, c, t, g, unknown or other
  modified_base (313)..(313): a, c, t, g, unknown or other
  modified_base (355)..(355): a, c, t, g, unknown or other
  modified_base (409)..(409): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgacaagtccagccacaatctttanacagttccaaacaatgaaaactacttagcttggtaccagcagagaccaggacagcctcctaggctgctcatttacnggcatctaccggatccggggtcccctgaccgattcagtggcnggcgggtctgggacagtatttcactctcaccatcagcagcctgcagctgaaagntgtgatagttatatgacaatattattattatacgttcgtagtacgtacgacgaaggacctaaggtacgatagaacgacgaacgtacgtagtacgtcgtacgtacg

SEQ ID NO: 430103 - DNA, 643 bp, Homo sapiens
  misc_feature: GZ8MTXP02GJZP6.19.71.G05.1.454.CMB.2.raw
  modified_base (239)..(239): a, c, t, g, unknown or other
  modified_base (313)..(313): a, c, t, g, unknown or other
  modified_base (372)..(372): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgacaagtccagccacaatctttanacagttccaacaatgaaaactacttagcttggaccagcagagaccaggacagcctctaggctgctcatttacgnggactactccgtaacccgggacgtcccggggtcccctagaccgtattcgaggtcggcgngggtcgggtcgtaggggactagttactttccaccttcctaccaacctatacgacgcacgccctgcgaggactagaaagtagtggtaggtacttaagttttaattacgttacgtaactaaacttaaatttaactttaatttaacgttacgtttcggttacgggtaccggtttaccgggaaccggtaaaacggggtaaccgtaaaggggttacggtaacttaacgtaacgtaacggtaaacggtaacggttacggtacggtacgtacgtaccg

SEQ ID NO: 430104 - DNA, 530 bp, Homo sapiens
  misc_feature: GZ8MTXP02GIYB0.19.71.G05.1.454.CMB.2.raw
  modified_base (341)..(341): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcactgggtcaggcagtccccatcgagaggtctagagtggctgggaagacatatttcatgtccaanacgtggaaatacaaattatgacactatctgtagagagtcgactagaacaaagtcaaacgtagaacaacaataccgaaagaacctagttcctccgtagacagactacgaccttctcggtacgaccgtacccggagtacgtacggtgttaactaagttacgaggtacggaacgaccggacccctagtaacg

SEQ ID NO: 430105 - DNA, 538 bp, Homo sapiens
  misc_feature: GZ8MTXP02FUHH9.19.71.G05.1.454.CMB.2.raw
  modified_base (237)..(237): a, c, t, g, unknown or other
  modified_base (252)..(252): a, c, t, g, unknown or other
  modified_base (375)..(375): a, c, t, g, unknown or other
  modified_base (411)..(411): a, c, t, g, unknown or other
  modified_base (417)..(417): a, c, t, g, unknown or other
  modified_base (426)..(426): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatnaaaactacttagcttggtaccagcagagaccaggacagcctcctaggctgctcatttactgggcatcctaaccggggaatccggggtcccctgacccgattcagtgctgcgggtctggggacnggtatttcactctcaccatcagcagcctagcaggcngaaagntggtcggtnttagtttattattagtactaaataattattaattattacgttcgtacggtacgtcgacgtaacggacgtaaggtagatagtaacgaacgaacgtacgtggtacgctacgacg

SEQ ID NO: 430106 - DNA, 645 bp, Homo sapiens
  misc_feature: GZ8MTXP02GLH0B.19.71.G05.1.454.CMB.2.raw
  modified_base (207)..(207): a, c, t, g, unknown or other
  modified_base (210)..(210): a, c, t, g, unknown or other
  modified_base (212)..(212): a, c, t, g, unknown or other
  modified_base (215)..(215): a, c, t, g, unknown or other
  modified_base (222)..(222): a, c, t, g, unknown or other
  modified_base (231)..(231): a, c, t, g, unknown or other
  modified_base (243)..(243): a, c, t, g, unknown or other
  modified_base (250)..(250): a, c, t, g, unknown or other
  modified_base (257)..(257): a, c, t, g, unknown or other
  modified_base (437)..(437): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggacgtgagaccnccncnacncctcgcncactctgcnctctccggcganagcgcancgacagngttgtctgtgactggtcgagacgacgtacccgtacctacgtacggaagggtacgtacgtaggtagggcggtagggtaaggggaaccgtaacttagtttactactagttaccgaactacgtacggtaaagtaaactaaaacttaattagacacccaattcttggttagagagttcgaaccngtaacaaatcgaaacgagtaacacaaatacggaaacgaaaccctaacgtttctaccccctggcaacgtacgttccgtaaaaccgttcccttggtacgtaccccgtacccggaccggggtaaagtaacggggttgttaaaacttagtttaaaccggtaagggtacgggaaaaccgggaaacccgtacccccaacgtaaagtaaccgacg

SEQ ID NO: 430107 - DNA, 598 bp, Homo sapiens
  misc_feature: GZ8MTXP02IS8M6.19.71.G05.1.454.CMB.2.raw
  modified_base (307)..(307): a, c, t, g, unknown or other
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgtgcttggcacgtgggtcaggcacgtccccatcgagngtctagagtggcgtaggggaagactattactttcagttcgtaccaaacgtacggtaggaaaactaacgtaaaatttatcgaccaacctattacgtgttagagtagtacgactagaacaatacaaacgtagacaactatacgaacgaaccagttacctacctagacagtctacgtaacccttcgtcgttacgacccgttacccggaacggtaccgtaacggggttacgttaagttaacgttaaccgttagggttacggaaacggtaacccggacccccgtaaagtaaaccgg

SEQ ID NO: 430108 - DNA, 534 bp, Homo sapiens
  misc_feature: GZ8MTXP02JY1HZ.19.71.G05.1.454.CMB.2.raw
  modified_base (490)..(490): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagacccctctcgctcacctgtcgccatccgtccggggacagagtcgctagcgacagtgttgcttggcacgtgggtcaggcagtccccatcgagagtctagagtggctggggaagacatatttcattgtccaaacacggtaggaataacaaagtttatagaccactaatctagttgagagtcgactgaacatacaaacgtagaacacatacgaagtaaccagttacctccgtagcagctcgacctctgtcgacctcccggaggaccgacgggttnttaagtaacgttacgtggtaggaaacgacggacccctagaacgg

SEQ ID NO: 430109 - DNA, 622 bp, Homo sapiens
  misc_feature: GZ8MTXP02IYIY1.19.71.G05.1.454.CMB.2.raw
  modified_base (227)..(227): a, c, t, g, unknown or other
  modified_base (236)..(236): a, c, t, g, unknown or other
  modified_base (249)..(249): a, c, t, g, unknown or other
  modified_base (258)..(258): a, c, t, g, unknown or other
  modified_base (279)..(279): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccanaatctttanacatacaaaatanaaactatancttagacagcagagacagacngcctctagctgctatattacgtggcatccgtaccgggtacgtccggggtcctacgaccgtattcgaggtcggccgacgggcggggttcgtacggggactagtactttcgacttcctaccacctatacagccacgtcctagacgtaggctaggaagtacgttggtacggtactttagttttaattagttacgtaactaaattaatttaatttaactttagttaccgtttcggttacgggtaaccggtttcgggaaaccgtaaacggggtaacctaaggggttacgtaaacttacgtacggaacggtaacgtaacgttcgggtacggaccttacggaacctaacg

SEQ ID NO: 430110 - DNA, 600 bp, Homo sapiens
  misc_feature: GZ8MTXP02I03YS.19.71.G05.1.454.CMB.2.raw
  modified_base (244)..(244): a, c, t, g, unknown or other
  modified_base (321)..(321): a, c, t, g, unknown or other
  modified_base (386)..(386): a, c, t, g, unknown or other
  modified_base (419)..(419): a, c, t, g, unknown or other
  modified_base (427)..(427): a, c, t, g, unknown or other
  modified_base (437)..(437): a, c, t, g, unknown or other
  modified_base (452)..(452): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccgatacgaactgacaagtccagccacaattcttttanacagttaccaacaatgaaaactctagcttaggaccagcaagagaccaggacagcctaccaggctgctcattttacgngggcataccgtaccccggggaatcccggggtcccccctaggacccggtattccgaggtcggaccngggtcgggtctaggggacagtactttcacttcnccactacncagcacgccngacgagactagaagngttggtagtacttaagtttattattacgtaacaaacttaattaattattacgtacgttacgtacggtacgtaccggaaccgtaacgggaacgtagggtacgtaactaacgtaacgaacgtaaaccgtacgtaggtacgtacgacgacc

SEQ ID NO: 430111 - DNA, 559 bp, Homo sapiens
  misc_feature: GZ8MTXP02G4GJ8.19.71.G05.1.454.CMB.2.raw
  modified_base (246)..(246): a, c, t, g, unknown or other
  modified_base (322)..(322): a, c, t, g, unknown or other
  modified_base (372)..(372): a, c, t, g, unknown or other
  modified_base (418)..(418): a, c, t, g, unknown or other
  modified_base (430)..(430): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgaggcgggccacgatacgaactgacaagtccagccacaattcttttanacagttccaacaatagaaaactacttagcttggtaccagcagagaccaggacagcctcaggctgctacatttacgnggcatccgtaccgggaacttccggggcccctgaccctattcgagtggacnggccgggtctggggacagtactttcactctacaccatcagcagccngacgagcagagngtgtgtattagtttatagtagtacaactaattattagttacttacgttacggtacggtacgttacggacgtaaacgggtaacgtaggtacgtaatacgaagaacgaacgtacgtgtacgtcgtacgacg

SEQ ID NO: 430112 - DNA, 648 bp, Homo sapiens
  misc_feature: GZ8MTXP02GYOHK.19.71.G05.1.454.CMB.2.raw
  modified_base (243)..(243): a, c, t, g, unknown or other
  modified_base (256)..(256): a, c, t, g, unknown or other
  modified_base (325)..(325): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccacgatacgaactgacaaagtccagccacaatcttttaanacagttaccaaanaatagaaaactacttagcttacgacagcagacgacaggacacgtcctacgtagctgctactatttacgnggactacgtaccgtaacccgggtaacgtcccggggtacccctacgaccgtacttcgaggtcggacgcgggtcgggtcgtacggggacagtactttaccgaccttcctaccaacctactaccgaagacgacgaccgtcgacgacgacgtacgaagtagtagtacggtacgttagtttagtttagttacgtactaaactaaattaattaatttaattacgttacgttacggttacggttacggtaccggtaaacggtaaacggtaacggtacggtaacgtaacgtaacgtaacgtaacgtaacgtacgtacggtacgtacgtacg

SEQ ID NO: 430113 - DNA, 517 bp, Homo sapiens
  misc_feature: GZ8MTXP02IJFOV.19.71.G05.1.454.CMB.2.raw
  modified_base (447)..(447): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctagggaaggacatatttcatgtaccaacacgtggaatacaaattatgcaccatctgttgagagtcgatgaacaatcaaacgtagacacatacgaaacgaacagttcctaccctgacagctgacctctgtcgaccgtccgaggacgacgggtntatattactagtaggaagacggtaccccagtacgactatacgccgtacctcgtctcgtcggtcgacttag

SEQ ID NO: 430114 - DNA, 639 bp, Homo sapiens
  misc_feature: GZ8MTXP02JTT7L.19.71.G05.1.454.CMB.2.raw
  modified_base (239)..(239): a, c, t, g, unknown or other
  modified_base (248)..(248): a, c, t, g, unknown or other
  modified_base (252)..(252): a, c, t, g, unknown or other
  modified_base (258)..(258): a, c, t, g, unknown or other
  modified_base (261)..(261): a, c, t, g, unknown or other
  modified_base (268)..(268): a, c, t, g, unknown or other
  modified_base (273)..(273): a, c, t, g, unknown or other
  modified_base (280)..(280): a, c, t, g, unknown or other
  modified_base (303)..(303): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgcaagtccagccacaatctttanacatacaanatanaaactntanctgacancaganacagacngcctcgagctgctctatttacgnggactacgtaccgtaacccgggacgtcccggggtcccctacggaccgtattcgaggtcggacgacggggtcgggtcgtacgggaactagttactttccgacttcctaccaacctactacgacgaccgacgccgtggacgaggtactaggaaagtgtagggtacgtacgttaagttttacttagttacgtaactaaaacttaatttaatttaactttaacgttacgttcggttacggttacggtttaccggtaacggtaaacgggtaaccgtaagggttacgtaacttaacgtaacgtaaacggtaaccgtaacgttcggtacggtacgtacgaccg

SEQ ID NO: 430115 - DNA, 595 bp, Homo sapiens
  misc_feature: GZ8MTXP02G4XCT.19.71.G05.1.454.CMB.2.raw
  modified_base (237)..(237): a, c, t, g, unknown or other
  modified_base (313)..(313): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgcaagtccagccacaatctttanacagttccaacaatgaaaactacttagcttggaccagcagagaccaggacagcctcctaggctagctcatttacgnggcacgtccgtaccggacgtccgggtcccctagaccgtatcgaggtcggacgcgggtcgggtcgtacggggactagtactttccactcctaccaacctatcgacgcacgcctgacgagacgtagaagtgtggtagtacttaagttttacttagttacgtaactaaataatttatttaatttacgttacgttcggtacggtaccggttacggaaccggtaaacgggaacgtaagggtacgtaatacgtaacgaacgtaacgtacgtggtacggacgtacgacc

SEQ ID NO: 430116 - DNA, 598 bp, Homo sapiens
  misc_feature: GZ8MTXP02JUWB5.19.71.G05.1.454.CMB.2.raw
  modified_base (236)..(236): a, c, t, g, unknown or other
  modified_base (314)..(314): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttaccaacaatagaaaactactagcttggtaccagcagagaccaggacagcctccgtaggctgctcatttacgnggcactccgtacccgggaacgtcccggggtcccctcgaccgtattcgaggtcggcgcggcggggtcgtggggacagtacgtttacactctacaccactcagcgacgcctcgcgacggctagaacgagtaggtcggcgttagtttattacgttagtactaaacttaattatttatttaacttaacgttcggttacggttaccggttacggaccggtaaacggggtaaccgtaagggtacggtaacgtagtaacgaacggtaacgaacgtggtacggtacgtgacc

SEQ ID NO: 430117 - DNA, 528 bp, Homo sapiens
  misc_feature: GZ8MTXP02HUUIE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcagtccccatcgagagtctagagtggctgggaagacatatttcatgtccaaacacgtaggaatacaaatttatcgacaccatctgttgagtagtcgactgacaatacaagttagacacatacgaaacgaaccagttcctacctgcagctagacccttcgtacgtacgacctccggaacgaccgtacggtagttaagtaacgttacgtggtacggacgtaccggacccctagtaacg

SEQ ID NO: 430118 - DNA, 631 bp, Homo sapiens
  misc_feature: GZ8MTXP02FZ5VT.19.71.G05.1.454.CMB.2.raw
  modified_base (242)..(242): a, c, t, g, unknown or other
  modified_base (310)..(310): a, c, t, g, unknown or other
  modified_base (318)..(318): a, c, t, g, unknown or other
  modified_base (364)..(364): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacaactgacaagtccagccacaattctttanacagttccaaacaatgaaaactacttagcttggaccagcagagaccaggacagcctcctaggctgctnatttacgnggcatccgaccggacgtccgggtcccctgacctatcgaggcgacgngggtccggtcgtagggacctagtacttccactctacacatacacgcacgcctgacgagactagaaagtagtggtggtacgttaagttttaacgttagttacgtaactaaacttaaatttaatttaacgttaactttacgtttacggttacgggttaccggtttaccggtaacccggtaaaaggggtaaacccgtaagggttaacggtaacttaaacggtaacgaaacgggtaaccgtaaacggttaggtacggtaccgtacgacccg

SEQ ID NO: 430119 - DNA, 629 bp, Homo sapiens
  misc_feature: GZ8MTXP02HRLDW.19.71.G05.1.454.CMB.2.raw
  modified_base (239)..(239): a, c, t, g, unknown or other
  modified_base (348)..(348): a, c, t, g, unknown or other
  modified_base (366)..(366): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanacagttaccaacaatagaaaactacttagcttggtaccagcagagaccaggacagcctcctaggctgctcatttactgggcatccgtacccgggaatccggggtccccngaccgtattcagtcggcnggcgggtctggggacagtactttcacctctacaccatcagcagccctgcgacggtcagaaagtagtggtacggtactaggtttttaatagtttacgtactaaaacttaattatttaaactttagttaccgtttacggttacgggttaccggttttaccggggaaccccgttaaaagggggaacccgtaaacggggttacgggtaaattacgttaaccgaaggtaacccggtaaacgttgggttaacgggcttacggtaacccc

SEQ ID NO: 430120 - DNA, 598 bp, Homo sapiens
  misc_feature: GZ8MTXP02IKEVA.19.71.G05.1.454.CMB.2.raw
  modified_base (244)..(244): a, c, t, g, unknown or other
  modified_base (396)..(396): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgacaagtccagccacaattctttttaanactacgttaccaaacaatagtaaaactacttagtacttacggtaccagacagacgaccaggacacgtcctaccgtagctgctactatttacgtggctactaccgtacccgggtaacgtcccggggtcccctacgaccgtactcgagtcgcgnggcgggtcgagggacagtacttcactcacacatacagcacgcctgacgagacagaagtagtagtcgtattagtttattagttagtactaaatattaattattacgtacttcggttacggtacgttacggaccgtaaacgggaccgtaaggtacgtaataacgtaacgtaacgaacgtaacgtacgtacggtacgtacgtacg

SEQ ID NO: 430121 - DNA, 605 bp, Homo sapiens
  misc_feature: GZ8MTXP02F3S4X.19.71.G05.1.454.CMB.2.raw
  modified_base (240)..(240): a, c, t, g, unknown or other
  modified_base (252)..(252): a, c, t, g, unknown or other
  modified_base (257)..(257): a, c, t, g, unknown or other
  modified_base (313)..(313): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccaacaatcttttaanactagtaccaanaatanaaactactagctagacagcagacgacagacacgcctcgtagctgctactattacgnggactacgtaccgtaaccgggtacgtcccgggtcctacgaccgtatcgaggtcgacgaggcgggtcgagggactagtacttacactctaccactactacgacgcgacgtccgtacgacgacgacgtagaagtagtagtaggtacgttagtttagttagttagtactaactaattaatttaattacgttacgttacgttacggtacggttacggtaccggtaaacggtaacggtaacggtacgtacgtacgtacgtaacgtaacgtaacgtacgtacgtacgtacgtactacg

SEQ ID NO: 430122 - DNA, 514 bp, Homo sapiens
  misc_feature: GZ8MTXP02IK1YQ.19.71.G05.1.454.CMB.2.raw
  modified_base (348)..(348): a, c, t, g, unknown or other
  modified_base (407)..(407): a, c, t, g, unknown or other
  modified_base (411)..(411): a, c, t, g, unknown or other
  modified_base (413)..(413): a, c, t, g, unknown or other
  modified_base (432)..(432): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcaccctgtgcccatctccggggacagagtcgctagcgacagtgttgcttggcactgggtcaggcagtccccatcgagaggtctagagtggctggggaagacagtatttcattgtccaanacgtggaaatacaaattatgacaccatctgttgagagtcgactgacaatcaaacgtaanacananacgaacgaactagtctccngcagctcgacctcgtcgtcgacctaccggacgacgtacggtataataagttacgtaggtacggaacgaccgaccctagtacg

SEQ ID NO: 430123 - DNA, 547 bp, Homo sapiens
  misc_feature: GZ8MTXP02HMRXX.19.71.G05.1.454.CMB.2.raw
  modified_base (233)..(233): a, c, t, g, unknown or other
  modified_base (305)..(305): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaacaatgaaaactactagcttagtaccagcagagaccaggacagcctctaggctgctcattacngggcatcgtaccggatccggggtcctgaccgattcgagtggcaggcgggtctgggacagtattcactctcacatcagcagcctgcaggctagaagtagtgtggtacttaagtttattattgtacaaataattatttaattattacgttcgtacggtacgtttaccggaccgtaaaggggacctaagggttcggaacttagtaccgaagtaccgtaacgtacggtaggacttcggactaaccg

SEQ ID NO: 430124 - DNA, 619 bp, Homo sapiens
  misc_feature: GZ8MTXP02JJN2S.19.71.G05.1.454.CMB.2.raw
  modified_base (244)..(244): a, c, t, g, unknown or other
  modified_base (328)..(328): a, c, t, g, unknown or other
  modified_base (389)..(389): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgaactgacaagtccagccacaattcttttaanactagtaccaaacaatagaaactacttagtcttagacagacagacgaccgaggacacgcctacgtaggctgctactatttacgnggctacgtaccgtaacccgggacgtcccggggtcccctacgaccgtattcgaggtcgacgngggtcgggtacgtacgggactagtactttacactctaccactactcagcacgtctcgacgacgacgtacgagtagtaggtacgtacgttagtttagttattacgtactaactaattaattaattaacttacgttacgttacggttacggttacggtacggtaacggtaacggtaacggtacggtaacgtacgtaacgtacgtaacgtacgtacgtacgtacgtacgtacg

SEQ ID NO: 430125 - DNA, 635 bp, Homo sapiens
  misc_feature: GZ8MTXP02H1DRB.19.71.G05.1.454.CMB.2.raw
  modified_base (229)..(229): a, c, t, g, unknown or other
  modified_base (240)..(240): a, c, t, g, unknown or other
  modified_base (328)..(328): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacgatacgaactgacaagtccagccanaatcttttaanacagtaccaaacaatagtaaactactagtcttacgaacagacagacgaccaggacacgccctacgaggctagtcctataagtttacgngggactaacgttacccggtaacccggggaacgttcccggggtcccccaggacccgtattcgagtacggcgcggcgggtcgtacggacgagtattactactcctaccaccactacacgacgacgcctcgcgacgacgtagaagtagtggtaggtagttagtttattattagtaacgtaaactaaattaatttaatttaacttaacgttacgttacggtacggttacggtaacggtaaacggtaacggtaacggtacggtaagtacgtaacgtaacgtaacgtaacgtacggtacggtacgtacgtacg

SEQ ID NO: 430126 - DNA, 505 bp, Homo sapiens
  misc_feature: GZ8MTXP02I2JE2.19.71.G05.1.454.CMB.2.raw
  modified_base (479)..(479): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaaggacagtatttcatgtccaaacacgtaggaatacgaaattatgacaccatctagttgagagtcgactgacaatcaaacgtagacacatacgaagaaccagttcctccctgcagctgacctctgtcactcccgaggacacggtgtataagttacgngtacggaagtacggaccccagtaacg

SEQ ID NO: 430127 - DNA, 627 bp, Homo sapiens
  misc_feature: GZ8MTXP02GIIR3.19.71.G05.1.454.CMB.2.raw
  modified_base (244)..(244): a, c, t, g, unknown or other
  modified_base (330)..(330): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgactgactaaagtccagccacaatcttttaanacagttaccaaacaatacgaaaactacttagcttagaccagacagacgaccagacacgcctacgtaggctgcttactaatttacgnggactacgtccgtaacccgggtagtcccggggtacccctagaccgtattccgaggtcggacgtagggccgggtacgtaggggactagtactttcacttctaccacatcgagacgacgccgtcgacgacgacgtagaagagtgtaggtacgttagtttattattacgtactaactaattaattaattaacttacgttacgttacggtacggttaccggtaccggtaaacggtaacggtaacggtacggtaagtaacgtaacgtaacgaacgtaacgtacggtacggtacgtacgtacg

SEQ ID NO: 430128 - DNA, 570 bp, Homo sapiens
  misc_feature: GZ8MTXP02IDC4P.19.71.G05.1.454.CMB.2.raw
  modified_base (235)..(235): a, c, t, g, unknown or other
  modified_base (312)..(312): a, c, t, g, unknown or other
  modified_base (363)..(363): a, c, t, g, unknown or other
  modified_base (535)..(535): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanacagttccaaacaatagaaaactacttagcttggtaccagcagagaccaggacagcctctaggctgctcatttacgnggcatccgtacccgggaatcccgggtccccctagacccgatcaggtcggcnggccgggtctggggactagtactttcactcctacacctatcaagcacgcctgcgaggctagaaagtgtggtagggtacttaaggttttattagttgtaacaaataattaatttattaattacgttcggttaggtaccgtttcggacctaaaggggtacctaagggtcgttanagtaaccgagaacgtaacgtgtcggactacgaccc

SEQ ID NO: 430129 - DNA, 511 bp, Homo sapiens
  misc_feature: GZ8MTXP02IRCNJ.19.71.G05.1.454.CMB.2.raw
  modified_base (237)..(237): a, c, t, g, unknown or other
  modified_base (312)..(312): a, c, t, g, unknown or other
  modified_base (358)..(358): a, c, t, g, unknown or other
  modified_base (373)..(373): a, c, t, g, unknown or other
  modified_base (503)..(503): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaacaatgaaaactacttagcttggtaccagcagagaccaggacagcctcctaggctgctcatttacngggcatctacccgggaatccggggtcccctgaccgattcagtggcnggcgggtctgggacngtatttcactctcaccatcagcagcctgcaggctgaaagatgtggctagtttattatgtacaataattattattatacttcgtggtacgttcggacaaagggaccaaggtgatataacgagacgaactgnggctgacc

SEQ ID NO: 430130 - DNA, 506 bp, Homo sapiens
  misc_feature: GZ8MTXP02GSREA.19.71.G05.1.454.CMB.2.raw
  modified_base (361)..(361): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctggggaagacatatttcatgtccaacacgtagaatacaaattntgacaccatctgttgagagtcgactgaacatacaaacgtagacacatacgaacgaaccagttctccctgcagctgacctcgtagtgaccgtaccgacggacacgggtgtataagttacgaggttaggaagacggaccccataacg

SEQ ID NO: 430131 - DNA, 537 bp, Homo sapiens
  misc_feature: GZ8MTXP02JV8A0.19.71.G05.1.454.CMB.2.raw
  modified_base (343)..(343): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtggtcaggcacgtccccatcgagagtctagagtggctgggaagacatattcatcgtccaacncgtagaatacaaattatgacaccatctgttgagtagtcgactagacaatcaaacgtagacacatacgaacgaaccagttcctaccctagcacgtctacgacctctcgtacgaccgtacccggaacggtaccgaccggggttataacgttaagttaaccgtaggtacggaaacggaccggacccccaagtaaccg

SEQ ID NO: 430132 - DNA, 550 bp, Homo sapiens
  misc_feature: GZ8MTXP02GXKAT.19.71.G05.1.454.CMB.2.raw
  modified_base (228)..(228): a, c, t, g, unknown or other
  modified_base (237)..(237): a, c, t, g, unknown or other
  modified_base (312)..(312): a, c, t, g, unknown or other
  modified_base (368)..(368): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaaacaatagaaaactacttagcttggtaccagcagagaccaggacagcctcaggctgctcatttacnggcataccgtacccggggaatcccggggtccccctggacccgtattccgagtggcngggcgggtctggggacagtactttcactctcaccatcagcagccctgcagggctagaagatggtgtctagtttatattgtacaactaattattattatacttcgtaggtacgttcggaccgtaaagggacctaagggtcggtaatagtaacgaagtaacggtaactggttacgcgtagaccc

SEQ ID NO: 430133 - DNA, 625 bp, Homo sapiens
  misc_feature: GZ8MTXP02IP0EZ.19.71.G05.1.454.CMB.2.raw
  modified_base (231)..(231): a, c, t, g, unknown or other
  modified_base (239)..(239): a, c, t, g, unknown or other
  modified_base (249)..(249): a, c, t, g, unknown or other
  modified_base (254)..(254): a, c, t, g, unknown or other
  modified_base (260)..(260): a, c, t, g, unknown or other
  modified_base (263)..(263): a, c, t, g, unknown or other
  modified_base (315)..(315): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctggggcgaggcgggccacgatcgaactgcaagtccagccanatctttanacactacaanaatanaaactntancttagacagcagacgaccaggacacgcctcgtaggctgctctacgtttacgnggactacgtccgtacccggaacgttcccggggtacccctacgaccgtattcgagtcggacgtcgggtcgggtcgagggactagtactttaccacctctacacctatacacgcacgcctgacgacggctaggtaaagtagttaggtacggtacgtttagttttaagtttacgttacgtaactaaacgttaatttaatttaactttaagttacgttacggttacggtaccggtttaccggaccggtaaacgggaaccgtaagggtacgtaatacgtaacgaacggtaacgtacgtggtacgtactacgaccg

SEQ ID NO: 430134 - DNA, 582 bp, Homo sapiens
  misc_feature: GZ8MTXP02HHKQB.19.71.G05.1.454.CMB.2.raw
  modified_base (242)..(242): a, c, t, g, unknown or other
  modified_base (320)..(320): a, c, t, g, unknown or other
  modified_base (366)..(366): a, c, t, g, unknown or other
  modified_base (383)..(383): a, c, t, g, unknown or other
  modified_base (412)..(412): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccgatcaactgcaagtccagccacaattcttttanacagttaccaacaatagaaaactactagcttggtaccagcagacgaccaggacagcctcctaggctgctcatttacgnggcatccgtacccgggatccggggtcccctgaccgtatcagtggcngcggtctgggactagtntttcactctacacccatcagcagtcccgngcgagcagagtgtgtcgtattagtttattagttacgtaactaaacttaatttatttaacgtttacgttacgttacggtaacggtaccggttaccgggaaccgtaaacgggaaccgtagggtacgtaagtacgtaacgtaacggtaacgtacgtggtacgtcgtacgtacg

SEQ ID NO: 430135 - DNA, 544 bp, Homo sapiens
  misc_feature: GZ8MTXP02JI1XS.19.71.G05.1.454.CMB.2.raw
  modified_base (238)..(238): a, c, t, g, unknown or other
  modified_base (314)..(314): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttccaaacaatagaaaactacttagcttggtaccagcagagaccaggacagcctcaggctgctcatttacgnggcatcgtaccgggatccccggggtcctgaccattcagtgcagcggtctgggacagtactttcactctcaccatcagcacgcctgcagctagacgatggtgactagtttatagttgtacaataattattattactacgtttacggtaggtaccggttacggaccgtaaacgggtaccgtaaagggtgtaaagtaagtaccgaaggtaaccgtaactggtacggtcctacg

SEQ ID NO: 430136 - DNA, 547 bp, Homo sapiens
  misc_feature: GZ8MTXP02GYNCJ.19.71.G05.1.454.CMB.2.raw
  modified_base (542)..(547): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggatccggggtccctgaccgattcagtggcagcgggtctgggacagatttcactctcaccatcagcagcctgcaggctgaagatgtggcctagtttattattgtacaaactaattatttattaatactttcgtggtacgtttcggaccctaaaggggaccaaaggggttgaatatacgagacgaacgtagtgcgtcgacaccactctcgtcttactactccttcccgtacctactctacgacgacgacgtacgtacgtaggacggcgggcggtcggacgaacggacgaacgagtagnnnnnn

SEQ ID NO: 430137 - DNA, 526 bp, Homo sapiens
  misc_feature: GZ8MTXP02JVPDK.19.71.G05.1.454.CMB.2.raw
  modified_base (358)..(358): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatatttcatgtaccacacgtaggaatacaaattntgacacatctgtgagagtcgactgaacaatacaacgtagacaacatacgaacgaaccagttctacctgcagctagacctctacgtcgaccgtacccggacggacggtacgggtacgtaagttacgttaacgtaggtacgggacggaccggtcccccaagtacgaaccg

SEQ ID NO: 430138 - DNA, 637 bp, Homo sapiens
  misc_feature: GZ8MTXP02IPYKG.19.71.G05.1.454.CMB.2.raw
  modified_base (225)..(225): a, c, t, g, unknown or other
  modified_base (234)..(234): a, c, t, g, unknown or other
  modified_base (243)..(243): a, c, t, g, unknown or other
  modified_base (247)..(247): a, c, t, g, unknown or other
  modified_base (256)..(256): a, c, t, g, unknown or other
  modified_base (269)..(269): a, c, t, g, unknown or other
  modified_base (300)..(300): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacatacaanatanaaactctanctagacagcaganacagacacgcctcgagctgctactattacgnggactacgtaccgtaacccgggacgtcccggggtcctacggaccgtatcgaggtcggacgacgggtccggggtcgtaggggaactagtactttccaccttcctaccaaccctataccgacgcacgccctgaccgaggtctagaagtagtggtacggtacgtttagtttattagttacgtaactaaaacttaatttaatttaatttaacgttacgtttacggtacgggttaccggttaccggaaaccggtaaacggggtaaaccgtaaaggggtacgtaacttaacgtacgtaaacggtaacggtaacgttcgggtacggtaccgtacgaccctaacg

SEQ ID NO: 430139 - DNA, 543 bp, Homo sapiens
  misc_feature: GZ8MTXP02H1G3H.19.71.G05.1.454.CMB.2.raw
  modified_base (239)..(239): a, c, t, g, unknown or other
  modified_base (251)..(251): a, c, t, g, unknown or other
  modified_base (318)..(318): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttaanacagttaccaanaatagaaactactagcttaggaccagcagacgaccaggacacgcctcgtagctgctactatttacgnggcataccgtaacccgggacgtcccgggtccccagaccgtatcgaggtcggcgcggtcgggtctacgggacagtacttcactctacacatcagcacgcctgcgaggctagaagtagtggtaggtattagtttattattgtaacaaactaattattaattatacgtgtacggtacgttcggacgaaggaactaggtgtatagaacgagacgacgtgtacgctacgc

SEQ ID NO: 430140 - DNA, 577 bp, Homo sapiens
  misc_feature: GZ8MTXP02H0MD7.19.71.G05.1.454.CMB.2.raw
  modified_base (242)..(242): a, c, t, g, unknown or other
  modified_base (288)..(288): a, c, t, g, unknown or other
  modified_base (319)..(319): a, c, t, g, unknown or other
  modified_base (402)..(402): a, c, t, g, unknown or other
  modified_base (420)..(420): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatcaactgacaagtccagccacaattctttanacagttaccaaacaatagaaaactcttaagcttaggaccagcaganaccaggacagcctcaggctgctcatttacgnggcatccgaccggatccccggggtcctgacgtattcgagtcggcaggcggtcagggacagtacttcactctcacatcagcacncctgccgagtcagaaagngtggtagtactagtttataagttcgtaactaactaaattatttataacgttaactttcggtacggttacgttaccgggaccgtaaaacggggtacctaaagggttcggtaaataacgttaccgaaaaggtaccgaaagttcggtaacgggtctaccg

SEQ ID NO: 430141 - DNA, 534 bp, Homo sapiens
  misc_feature: GZ8MTXP02H6KJA.19.71.G05.1.454.CMB.2.raw
  modified_base (239)..(239): a, c, t, g, unknown or other
  modified_base (313)..(313): a, c, t, g, unknown or other
  modified_base (349)..(349): a, c, t, g, unknown or other
  modified_base (359)..(359): a, c, t, g, unknown or other
  modified_base (390)..(390): a, c, t, g, unknown or other
  modified_base (400)..(400): a, c, t, g, unknown or other
  modified_base (513)..(513): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctcgtggcgagcgggccaccatcaactgcaagtccagccacaattcttttanacagttaccaaacaatgaaaactactagcttggtaccagcagagacaggacagcctctaggctgctcatttcgnggcatccgtaaccggatcccgggtcccctgaccgtntcgagtggcngcgggtctgggacagactttcactcacactnacagcatccngaccaggctagaaagtgtaggtcggtattaagtttattatttacgaactaaataagttatttaatagttacgttacgtgtaacgttcggactaaaggggacaaggttcgatancgataacgatgcggactgacc

SEQ ID NO: 430142 - DNA, 543 bp, Homo sapiens
  misc_feature: GZ8MTXP02GHCGT.19.71.G05.1.454.CMB.2.raw
  modified_base (226)..(226): a, c, t, g, unknown or other
  modified_base (235)..(235): a, c, t, g, unknown or other
  modified_base (246)..(246): a, c, t, g, unknown or other
  modified_base (311)..(311): a, c, t, g, unknown or other
  modified_base (379)..(379): a, c, t, g, unknown or other
  modified_base (390)..(390): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanatctttaanacagttccaanaatagaaaactctagcttggtaccagcagagaccaggacagcctcctaggctgctctatttacgngggcaattccgtaaccccggggaatccccggggtcctgacccgtattcgacgtggccaggccggggtntggggacagtntttcgactctcaccatcagcagcctgcaggctgaagatgtggctagtttattattgtacaataattattattataccgttgtaggtacgttcggaccgtaaaggaccaaggtgaactagtacgaagaacgtactaggtcgactcggactaacg

SEQ ID NO: 430143 - DNA, 515 bp, Homo sapiens
  misc_feature: GZ8MTXP02JBRDK.19.71.G05.1.454.CMB.2.raw
  modified_base (237)..(237): a, c, t, g, unknown or other
  modified_base (312)..(312): a, c, t, g, unknown or other
  modified_base (357)..(357): a, c, t, g, unknown or other
  modified_base (417)..(417): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacatcgaactgcaagtccagccacaatctttanacagttccaacaatgaaaactactagcttggtaccagcagagaccaaggacagcctcctaggctgctcatttacngggcatcgtacccggaatccgggtcccctgaccgattcagtggcnggcgggtctggggacagtactttcactctcaccatcagcagcctgacaggctgaagatgnggtatagtttattattgtacaataattattattatacttcgtagacgtttacggacctaaagggccaagggtacgatagtcagacgactgtggctagc

SEQ ID NO: 430144 - DNA, 549 bp, Homo sapiens
  misc_feature: GZ8MTXP02JO99Z.19.71.G05.1.454.CMB.2.raw
  modified_base (227)..(227): a, c, t, g, unknown or other
  modified_base (235)..(235): a, c, t, g, unknown or other
  modified_base (238)..(238): a, c, t, g, unknown or other
  modified_base (242)..(242): a, c, t, g, unknown or other
  modified_base (244)..(244): a, c, t, g, unknown or other
  modified_base (246)..(246): a, c, t, g, unknown or other
  modified_base (251)..(251): a, c, t, g, unknown or other
  modified_base (253)..(254): a, c, t, g, unknown or other
  modified_base (265)..(265): a, c, t, g, unknown or other
  modified_base (273)..(273): a, c, t, g, unknown or other
  modified_base (292)..(292): a, c, t, g, unknown or other
  modified_base (339)..(339): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanatctttanacntcanananaactntnntgacagcaganacagacancctcagctgctcattacgnggcataccgtaccggtacgtccgggtcccctgaccgtatcagtgcgnggcgggtctagggacagtacttcactctacacatcagcacgcctgacgagctagaagtgtggtggtacttagtttattagttcgtactaaactaattaattaattacgttacgttcggttacggtacggttaccggaaccgtaaacgggtaaccgtaagggtacgtactacgtaacgaacgtaacgtacgtcggtacgtacgtacgaccg

SEQ ID NO: 430145 - DNA, 504 bp, Homo sapiens
  misc_feature: GZ8MTXP02HM1R6.19.71.G05.1.454.CMB.2.raw
  modified_base (362)..(362): a, c, t, g, unknown or other
  modified_base (406)..(406): a, c, t, g, unknown or other
  modified_base (414)..(414): a, c, t, g, unknown or other
  modified_base (425)..(425): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccacacgtaggaaatacgaaaattangtcacctatctgttgagagtcgactgacaatacaacgtagacanatacgaanaccagttaccncctgcagctcgactctcgtcgactcccgaggacgacgggtacgtatattaacgtagtaggacgaggaccccatacgaac

SEQ ID NO: 430146 - DNA, 540 bp, Homo sapiens
  misc_feature: GZ8MTXP02J3CJR.19.71.G05.1.454.CMB.2.raw
  modified_base (370)..(370): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcagtccccatcgagaggtctagagtggctggggaagacagtatttcattgtccaaacgacgtggaataacaaatttangacaccatctgttagagagtacgactagaacatacaaacgtagacacatacgaaacgaacctagttcctacccgtacgacacgtctacgtacctcgtacgtacgaccgtacccgacggaccgacgggtagtaactaagttacgtcgtaggaacgaccggaccccaatacg

SEQ ID NO: 430147 - DNA, 539 bp, Homo sapiens
  misc_feature: GZ8MTXP02F3M5K.19.71.G05.1.454.CMB.2.raw
  modified_base (497)..(497): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagaggtctaggagtggctaggggaaggacagttatttcattgtccaaacacggtaggaaatacaaattatgacaccatctgttgagagtcgactgaacaatcaaacgtagaacacatacgaaacgaacctacgttcctaccctgacagcctacgtaccctcgtgtacgaccgtacccggaggaccgtacgggtntaataagttacgtaggtacggaacgaccggaccccagtaacg

SEQ ID NO: 430148 - DNA, 622 bp, Homo sapiens
  misc_feature: GZ8MTXP02HWQJW.19.71.G05.1.454.CMB.2.raw
  modified_base (242)..(242): a, c, t, g, unknown or other
  modified_base (254)..(254): a, c, t, g, unknown or other
  modified_base (278)..(278): a, c, t, g, unknown or other
  modified_base (314)..(314): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagccgggccacgatacgaactgactaagtccagccactaatctttanactactaccaanatacaaactactagtctacgacancagacgacagacacgcctcagctgctactattacgnggacagtaccgtaaccgggacgtccgggtcccctacgaccgtattcgagtcggacgcgggtcgggtacgtcggactagtacttacactctaccacctagtacgacgacgacgtacgtacgacgacggtacgtacgaagtagtaggtacggtacgtagtttagttagttacgtaactaaacttaaattaattaattaacgttacgttacgttacggttacggttaccggtacggtaaacggtaacggtaacggtacggtaagtacgtaacgtaacgtaacggtaacgtacggtacggtacgtacgtacg

SEQ ID NO: 430149 - DNA, 615 bp, Homo sapiens
  misc_feature: GZ8MTXP02F0JUA.19.71.G05.1.454.CMB.2.raw
  modified_base (238)..(238): a, c, t, g, unknown or other
  modified_base (247)..(247): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (310)..(310): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtcagccacaatctttanacatacaanatanaaactntanctagacagcagacgacagacacgtcctcgtaggctgactctagtttacgnggactacgtaccgtaccgggtacgtcccgggtcccctagaccgtatacggaggtcggaccgtggggtccgggtacgtacggggactagttactttccacttcctaccaaccctagtacgacgacgacgccgtcgacgacgacgtacgtaagtagtagtacgtagttagtttagttagttacgtactaactaattaattaattaacttacgttacggttacggtacggttacggtacggtaaacggtaacggtaacggtacgtagtacgtaacgtacgtaacgtacgtacgtacgtacgtacgacg

SEQ ID NO: 430150 - DNA, 605 bp, Homo sapiens
  misc_feature: GZ8MTXP02F3105.19.71.G05.1.454.CMB.2.raw
  modified_base (240)..(240): a, c, t, g, unknown or other
  modified_base (249)..(249): a, c, t, g, unknown or other
  modified_base (251)..(251): a, c, t, g, unknown or other
  modified_base (253)..(253): a, c, t, g, unknown or other
  modified_base (259)..(259): a, c, t, g, unknown or other
  modified_base (262)..(262): a, c, t, g, unknown or other
  modified_base (308)..(308): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttanacatacaanananaaactntanctagacagcagagacagacacgcctacgtagctgctactattacgnggacactccgtaacccgggtacgtcccccgggtacctacgaccgtattcgaggttcggccgacgggcgggtcgtacggggactagtactttcactcctaccaccatcacgacgacgcgtacgcgacgacgtagaagagtaggtaggtacgttagtttattagttagtaactaaactaaattaattaattaacttacgttacggttacggttacggttacggtaccggtaaacggtaaccgtaaacggtaaggtaagtaacgtacgtaacgtaacgtaacgtacggtacgtacgtacg

SEQ ID NO: 430151 - DNA, 565 bp, Homo sapiens
  misc_feature: GZ8MTXP02G73JT.19.71.G05.1.454.CMB.2.raw
  modified_base (240)..(240): a, c, t, g, unknown or other
  modified_base (251)..(251): a, c, t, g, unknown or other
  modified_base (311)..(311): a, c, t, g, unknown or other
  modified_base (338)..(338): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttanacagttccaanatgaaaactctagctggtaccagcagagaccaggacagcctctaggctgctcatttacgnggcatcgaccggacgtccccgggtccngaccgtattcgagtcggcgaggcggtcgtgggacagtcttcactctaccaccatcacgcacgcgtcgcgacgacgagagtagtgtgtacgttagtttagttattacgtactaactaattaattaattacgttacgttacgtacggtacggttacggtacggtaacgggtacggtaacggtaggtagtaacgtacgtaacgtacgtaacgtacggtacggtacgtacg

SEQ ID NO: 430152 - DNA, 532 bp, Homo sapiens
  misc_feature: GZ8MTXP02J5CCL.19.71.G05.1.454.CMB.2.raw
  modified_base (270)..(270): a, c, t, g, unknown or other
  modified_base (354)..(354): a, c, t, g, unknown or other
  modified_base (373)..(373): a, c, t, g, unknown or other
  modified_base (375)..(375): a, c, t, g, unknown or other
  modified_base (380)..(380): a, c, t, g, unknown or other
  modified_base (413)..(413): a, c, t, g, unknown or other
tcagtactctcgtgcacgaccggtgctcgatttagtgtcgtcgcaagagagagggggtcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtgccagtctccggggacagagtcgctagcgacngtgttgcttggcacgtgggtcaggccacgtccccatcgagtaggtctaggagtggctagggaagtcatatttcattgtccaaanacgtagaatacaaatttancncactntcgtgtagagtagtcacagaacatacaacgtanacacacgtacgaacgtacctacgttcctccgtcgcacgtcgtacgtactcgtcgtcgtaccgtaccgacggacgtacggtagtattaagtacgtacgtacggacgacgaccgacgtacg

SEQ ID NO: 430153 - DNA, 645 bp, Homo sapiens
  misc_feature: GZ8MTXP02ILN99.19.71.G05.1.454.CMB.2.raw
  modified_base (240)..(240): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattcttttanacagttccaaacaatagaaaactacttagcttaggaccagcagagaccaggacagcctctaggctgctctatttacgtgggactacgtaccgtaaccccggggaacgttccccggggtacccccctaggaacccgtatttaccgaaggttcgaaccgaggggtccggggttacgtacgggggacctaaggtactttaccacctcctaccaaccctatccaagccacgtccctagaccaagggccgtaagaaagtagtggtacggtagttaagtttttaattaattgtaacctaaataaattaatttaattaattacgtttacggtaggtaaccgtttcggaaccgtaaaggggaacctaagggtacgtaatataacgaagaacgtaacgtggtacgcttacgacc

SEQ ID NO: 430154 - DNA, 624 bp, Homo sapiens
  misc_feature: GZ8MTXP02HGC5A.19.71.G05.1.454.CMB.2.raw
  modified_base (256)..(256): a, c, t, g, unknown or other
  modified_base (322)..(322): a, c, t, g, unknown or other
  modified_base (367)..(367): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctggggcgagccgggccaccgatcgaactgacaagtccagccacaatctttttagacagttccaanaatgaaaactcttagacttggaccagcagagaccaggactagcctcctaggctgctcattttacgnggacacgtaccgtaccgggacgtccggggtaccccctagaccgtntcgaggtcgcgcggcgggtcacgggactagtactttacactctacacctatcacgacgacgtcgtcgacgacggacgtacgaagtagtaggtacggtacgtagtttagtttacgttacgtaactaaactaaacttaattaattaacttaacgttacgttacggtaccggttacggtaaccggtaaacggtaaacggtaacggtacggtaagtaacgtaacgtaacgtaacgtaacgtacgtacggtacgtacgtacg

SEQ ID NO: 430155 - DNA, 611 bp, Homo sapiens
  misc_feature: GZ8MTXP02H94GG.19.71.G05.1.454.CMB.2.raw
  modified_base (239)..(239): a, c, t, g, unknown or other
  modified_base (320)..(320): a, c, t, g, unknown or other
  modified_base (349)..(349): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcaggcgggccaccgatacgaactgacaagtccagccacaattctttanacagttccaaacaatacgaaaacttcttagcttaggtaccagcagagaccaggacagccctcgtaggctgctcatttacgnggctagtccgaccggtacgtccgggtccncgaccgtattcgaggtcggcgacgggtcggggtcgtacgggactagtactttaccacttcctaccacctatacacgcacgccgtcgacgacgacgtagaagtagtagtacggtacgttagtttagttagttagtactaaactaattaattaattaattacgttacgttacggttacggttacggtacggtaacggtaacggtaacggtacgtacgtacgtacgtaacgacgtaacgtacggtacggtacgtacgtacgtacg

SEQ ID NO: 430156 - DNA, 491 bp, Homo sapiens
  misc_feature: GZ8MTXP02JS9GS.19.71.G05.1.454.CMB.2.raw
  modified_base (317)..(317): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcactgggtcaggcagtccccatcgagaggtctagagtggctgggaagacatatttcatgtccaanacgtgaatacaaattatgcaccatctgttgagagtgactgacaatcaacgtagacacatacgaagaaccagttctaccctgacagctcgacctctgtgactcccgaggacacgggtgtatatactgtggaagacggcccatacgacatcgccactcgtctcgtggtacgctaag

SEQ ID NO: 430157 - DNA, 566 bp, Homo sapiens
  misc_feature: GZ8MTXP02H68FX.19.71.G05.1.454.CMB.2.raw
  modified_base (229)..(229): a, c, t, g, unknown or other
  modified_base (239)..(239): a, c, t, g, unknown or other
  modified_base (242)..(242): a, c, t, g, unknown or other
  modified_base (303)..(303): a, c, t, g, unknown or other
  modified_base (311)..(311): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccgacggggacatcgtgatgacccagtctccagactccctggctgtgtctctgggcgagcgggccacgatacgaactgacaagtccagccanaattctttanacngttaccaacaatgaaaactctagcttgaccagcagacgacaggacagcctctagctgactnatttacgnggcatccgtaccgggagtccgggtcctgaccgtattcgaggtcggcgaggtcgggtacgtagggactagtacttcactcctacacactcagcacgtccgtagacgacggtactagaagtagtaggtcggtacttagtttattagttacgtaacaaactaatttaattattaattacgttagtacggtacgttacggacgtaaacggacgtaaaggtacgatacgtacgaacgtacgacgtcgagctacgactacg

SEQ ID NO: 430158 - DNA, 576 bp, Homo sapiens
  misc_feature: GZ8MTXP02GGVHA.19.71.G05.1.454.CMB.2.raw
  modified_base (239)..(239): a, c, t, g, unknown or other
  modified_base (315)..(315): a, c, t, g, unknown or other
  modified_base (366)..(366): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattctttanacagttccaacaatagaaaactacttagcttggtaccagcagagaccaggacagcctccaggctgctcatttacgnggcatcctacccggggaatcccggggtccccctgacccgattcaggtcgcngggtcgggtctaggggactagtatttccactctacacccatcagcagcctgcaggctagaaagtgtaggtggtactaggtttatttagttacgtaacaaattaaattaatttaattattaacgttcgttacggtacgtttcggacgtaaacggggacctaaacggggtagaactagtaaccgaagtacgtaaacgtgtacggctacgacc

SEQ ID NO: 430159 - DNA, 569 bp, Homo sapiens
  misc_feature: GZ8MTXP02H0U1A.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgcccatccgtcccggggacagacgtcgctagcgacaggtgttgcttggcacgtgggtcaggcacgtccccagtcgagagtctaagaggtggcgtggggaagactatatttcatgtccaaacgtacgtagaaataacaaattatgacaccatcgtgttagagagtacgactagaactatacaacgtaacgacaactagtacgaaacgtaaccctaagttccctacccgtagactacgtactcgaacccttgtacgtacgaaccttacccgggaacggacgtaccgggtataagttaacgttacgtagtacggaacgaccgaccccttaagaccg

SEQ ID NO: 430160 - DNA, 653 bp, Homo sapiens
  misc_feature: GZ8MTXP02IOX59.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccatcgagagtctagagtggctaggggaacgactagtatttcattcgtccaaacgtacggtagggtaaaattaaccgtaaaatttatacgacctaacctaattcgttaggttgtaagtacggttccggtaacttaggaaactaaacttacgaaaacgttagaacaactaagtaaccgaaaggtaaaccctacgtttaccctaccccgttaggacctaggtacctacgtaaccctttacgtcggtttaccgacccgttaccccgggaacgggtaccgtaaccggggttattaaaccgtttaagtttaaccgtagggttaaacgggaacgaacccgggtaccccctaagttaaaccgg

SEQ ID NO: 430161 - DNA, 620 bp, Homo sapiens
  misc_feature: GZ8MTXP02JRERL.19.71.G05.1.454.CMB.2.raw
  modified_base (239)..(239): a, c, t, g, unknown or other
  modified_base (250)..(250): a, c, t, g, unknown or other
  modified_base (255)..(255): a, c, t, g, unknown or other
  modified_base (317)..(317): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatcttttaanacagtaccaanaatanaaaactactagcttaggaccagacagacgaccagacacgcctacgagctgctctatttacgnggctagtccgtaacccgggagtccggggtcccctagaccgtattacgaggtcggcgcggtcgggtacgtagggactagtactttcactctacaccatacagccacgcctcgacgacgacgtagaagtagtaggtacggtacgttagtttaatttaagttagtaactaaactaaattaatttaatttaattacgtttacggttacggttacggttaccggtaaccggtaaacgggtaaacggtaacgggtacggtaagtacgtaacgtaacgtaacgtaacgtacggtacggtacgtacgtacg

SEQ ID NO: 430162 - DNA, 536 bp, Homo sapiens
  misc_feature: GZ8MTXP02I28U4.19.71.G05.1.454.CMB.2.raw
  modified_base (238)..(238): a, c, t, g, unknown or other
  modified_base (313)..(313): a, c, t, g, unknown or other
  modified_base (419)..(419): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgacaagtccagccacaatctttanacagttccaaacaatagaaaactactagcttaggtaccagcagagaccaggacagcctctaggctgctcattacngggcatctaccgggaatccggggtcctgaccgattcgagtggcagcggggtctgggacagtatttcactctacacctatcagcagcctgcaggtcagagatgtggntagtttattattgacaataattattattatacgttcgtagtaacgttcggacgaaacgggacctaagggtacgaactatacgaaggtacgaacttacgggtacgtactacgactacg

SEQ ID NO: 430163 - DNA, 653 bp, Homo sapiens
  misc_feature: GZ8MTXP02JV8N0.19.71.G05.1.454.CMB.2.raw
  modified_base (240)..(240): a, c, t, g, unknown or other
  modified_base (250)..(250): a, c, t, g, unknown or other
  modified_base (255)..(255): a, c, t, g, unknown or other
  modified_base (316)..(316): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaatcttttaanacataccaanaatanaaactactagcttagacagcagacgacgagacacgcctcgtaggctgctactagtttacgnggactacgtaccgtaacccggggtacgttcccggggtaccccctacggaccgtattcgaggtcggacgcggggtccgggtacgtacgggactagttactttaccaccttcctaccctaacctactacgacgacctacgccctacgacgacgacgtagaagtagtggtcggtacgttagtttatttagttacgtaactaaacttaaattaatttaatttaacgttaacgttacggttacggttacggttaccggtaaccggtaaacggtaaacggtaacggtacggtaacgtaacgtaacgtaacgtaacggtacgtacggtacggtacgtacgtacg

SEQ ID NO: 430164 - DNA, 536 bp, Homo sapiens
  misc_feature: GZ8MTXP02HI5JL.19.71.G05.1.454.CMB.2.raw
  modified_base (391)..(391): a, c, t, g, unknown or other
  modified_base (460)..(460): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccgggacagagtcgctagcgacagtgtgcttggcacgtgggtcaggcacgtccccatcgagaggtctaggagtggctggggaagacattatttcatcgtaccaacgacggtagaactacaaattatgacaccatcgtagttgagagtcgactgaacaatacaacgtagacanatacgaacgaacctagttcctcctagcagtctacgtacctctagtcgacgtcccgaggacgtacgggtntatagtacgtgtaggaacgtaccgacccagtacgacacgtccgaaccgtacctcggtctcgtcggtcgtacttaag

SEQ ID NO: 430165 - DNA, 751 bp, Homo sapiens
  misc_feature: GZ8MTXP02I4VX0.19.71.G05.1.454.CMB.2.raw
  modified_base (238)..(238): a, c, t, g, unknown or other
  modified_base (316)..(316): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccactaatctttanacagttaccaaacaatagaaaactctagcttaggaccagcagagaccaggacagcctcctaggctgctctatttacgnggctatccgtacccgggaagtcccggggtcccctggaacccgtattaccgaggttcggacaggggtccggggtctagggggaacctagggttaactttccaaccgttcctaccaacccgtaatccgaaagcccgaagccccgttaggacccgtaaggggcctaaggtaaaacggacgtttggttaccggggtaactttaaagggttttttattaaagtttacggttaacctaaaaacgttaaattttaaagttttaaacttttaacgttaaacccgttttaggggttaccggggttaaacccggttttacccggggaaacccggttaaaacgggggaaacccgtaaaacggggtttaacgggtaaagttaacgttaaccgaaacgggttaaacccgtaaaacggttaggtacgggtaacccgttcggtaaacccc

SEQ ID NO: 430166 - DNA, 528 bp, Homo sapiens
  misc_feature: GZ8MTXP02GTV7A.19.71.G05.1.454.CMB.2.raw
  modified_base (347)..(347): a, c, t, g, unknown or other
  modified_base (365)..(365): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccggggacagagtcgctagcgacagtgttgcttggcacgtgggtcaggcacgtccccatcgagaggtctagagtggctggggaagacatatttcatgtccaanacgtagaaatacaaattntcgacaccatactgttagagagtcgactagacaatacaaacgtagacaacatacgaacgaaccacgttacctaccctgacacgctacgacctctgtcgaccgtccggacggacgacggtcgtaataagttacgtaggtacggaacgacggaccccaagtaacg

SEQ ID NO: 430167 - DNA, 516 bp, Homo sapiens
  misc_feature: GZ8MTXP02JMUW6.19.71.G05.1.454.CMB.2.raw
  modified_base (238)..(238): a, c, t, g, unknown or other
  modified_base (360)..(360): a, c, t, g, unknown or other
  modified_base (416)..(416): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatcgtacccgggatccggggtcccctgaccgattcagtcggcnggcgggtctggggacagtatttcactctcaccatcagcagcctgcaggctgaaagntgtgctagtttatattgacaactaattattaattatacttcgtagacgttcggaccaaagggccaaggtcgatatcgagtacgaactgtacggctcgacc

SEQ ID NO: 430168 - DNA, 487 bp, Homo sapiens
  misc_feature: GZ8MTXP02HQLO0.19.71.G05.1.454.CMB.2.raw
  modified_base (341)..(341): a, c, t, g, unknown or other
  modified_base (356)..(356): a, c, t, g, unknown or other
  modified_base (415)..(415): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaacgacatatttcatgtccacncgtgaatacaaattngacacatctgtgagagtcgactgacaatacaacgtagacacatacgaagaacagttccncctagcagctgactctacgtcgactcccgaggacacggtatatataacgtgtacgacgacgccccatacgac

SEQ ID NO: 430169 - DNA, 535 bp, Homo sapiens
  misc_feature: GZ8MTXP02JZY7D.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgcccatcgtccggggacagagtcgctagcgacagtgttgcttggcacgtgggtcaggcacgtccccatcgagaggtctagagtggctaggggaagacattatttcattcgtccaacacggtaggaaatacaaatttatcgacaccatctgttgagagtcgactagacaatacaaacgtagacacatacgaacgaacctacgttcctaccctgacacgcctacgacctcgtcgtcgaccgtacccggacggaccgacgggtagtataacgttacgtggtacggacgacggaccccgatacg

SEQ ID NO: 430170 - DNA, 545 bp, Homo sapiens
  misc_feature: GZ8MTXP02HA9IT.19.71.G05.1.454.CMB.2.raw
  modified_base (238)..(238): a, c, t, g, unknown or other
  modified_base (313)..(313): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctctaggctgctcatttacnggcatcctaccgggatccccggggtcctgaccattcagtggcagcgggtctgggacagtatttcactctcacatcagcacgcctgcaggctagaagatggtggactagtttattagttagtactaaactaaattatttaattattacgtttacggtaggtaccgtttcggaccgaaagggtaccgtaagggtggaataagtacgaacggtacgtaactaggtcggtactacg

SEQ ID NO: 430171 - DNA, 584 bp, Homo sapiens
  misc_feature: GZ8MTXP02H0IWK.19.71.G05.1.454.CMB.2.raw
  modified_base (451)..(451): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcggagaggtctaaggaggtggcgtaggggaagactagtactttcgattcgtcccaaacgtacggtaggtaaaactaacctaaaattatacgaccaaccctattaccgtgttaggagtagttcgaactagaacaagtacaaaacggtaanacaactaagtaacgaaacgaacctacgttacctacctagactagcctacgtacctcgtacgtacgaccgtaccggacgtacgtacggtagtactaacgttacgtacggtacggaacgaccgaccctaagtacg

SEQ ID NO: 430172 - DNA, 595 bp, Homo sapiens
  misc_feature: GZ8MTXP02GH7NH.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgttgcttggcacgtggtcaggcacgtccccagtcgagaggtctaggagtggcgtggggaaaggactagttatttcattcggtacccaacacggtaggaaataacaaatttatcgacactatcgtgttgagtagtcgatgaacaatcgaaagtagaacacaacgtacgaaacgtaacctacgttaccctaccctagacgacgtcctacggaccccttcgtacgttacggacccgttacccggaacggtaccggtaaccgggttgttaagttaacgtttaccggtaggttaacgggaacggtacccggacccccgtaagtaacccg

SEQ ID NO: 430173 - DNA, 575 bp, Homo sapiens
  misc_feature: GZ8MTXP02GHCNX.19.71.G05.1.454.CMB.2.raw
  modified_base (236)..(236): a, c, t, g, unknown or other
  modified_base (238)..(238): a, c, t, g, unknown or other
  modified_base (245)..(245): a, c, t, g, unknown or other
  modified_base (249)..(249): a, c, t, g, unknown or other
  modified_base (258)..(258): a, c, t, g, unknown or other
  modified_base (305)..(305): a, c, t, g, unknown or other
  modified_base (395)..(395): a, c, t, g, unknown or other
  modified_base (399)..(399): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgactaagcagcacatctttananatacaanatanaactatagntagacagacagacgacagacacgcctacgagctgctactatttacgnggctacgtaccgtaaccgggacgtcccgggtcccctagaccgtatacgagtcgacgcggcgggtcgtaggacagtacttcactcacacanacancgacgctcgcgacgacgtagagtagtgtcgtagtagtttattattagtactaactaattaattaattacttacgttacgtacggtacggttacggtaacggaaacgggtaacggtaacggtacggtaagtaacgtaacgtaacgtaacggtacgtacggtacggtacgtacgtacg

SEQ ID NO: 430174 - DNA, 645 bp, Homo sapiens
  misc_feature: GZ8MTXP02GFOGN.19.71.G05.1.454.CMB.2.raw
  modified_base (240)..(240): a, c, t, g, unknown or other
  modified_base (249)..(249): a, c, t, g, unknown or other
  modified_base (253)..(253): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttanacatacaanatanaaactctagctgacagcagacgacagacacgcctcgagctgctactattacgtggactacgtaccgtaaccgggacgtcccggggtacccctacgaccgtattcgagtcggacgtcggggtcgggtacgtaggggactagttactttccacttacctaccaacctagtacgacgacgacgaccgtcgacgacggtacgtacgtaagtagtaggtacggtacgttagtttaagtttagttacgttaactaaacttaaattaaatttaatttaacgttaacgtttacggttacggttacggttaccggtaaccggtaaacggtaaacggtaaacgggtaacggtaacgtaacgtaacgtaacgtaacggtacgtacgtacggtacgtacgtacg

SEQ ID NO: 430175 - DNA, 568 bp, Homo sapiens
  misc_feature: GZ8MTXP02JVBL9.19.71.G05.1.454.CMB.2.raw
  modified_base (237)..(237): a, c, t, g, unknown or other
  modified_base (322)..(322): a, c, t, g, unknown or other
  modified_base (376)..(376): a, c, t, g, unknown or other
  modified_base (413)..(413): a, c, t, g, unknown or other
  modified_base (439)..(439): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccaacaattcttttanactagttaccaaacaatagaaaactacttagcttaggtaccagcagacgaccaggacacgcctcctaggctgcctctatttacgngggcagtccgtacccggggatcccggggtccccctgaccgtattcgagtcggcngggcgggtctaggggacagtactttcactcctcaccntcagcacgcctgccaggctagaaagntggtggacttagtttattattagtacctaaataattatttattactacgttcggtacggtaccgttcggaccgaaaggggacctagggtacgattagaacgaacggaacgtacgtggtcgtctagaccc

SEQ ID NO: 430176 - DNA, 515 bp, Homo sapiens
  misc_feature: GZ8MTXP02FRF7M.19.71.G05.1.454.CMB.2.raw
  modified_base (318)..(318): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatattcatgtccaanacgtgaatacaaattatgacaccatctgttagagagtcactgacaaatcaaacgtagacacatacgaagaaccagttcctaccctgcagctcgacctctgtcgacctcccgaggacgtacgggtagttatacttacgtgtaggaagacggccccaagtacgacactcgcctacctcgtactcgtggtcgtacttaag

SEQ ID NO: 430177 - DNA, 549 bp, Homo sapiens
  misc_feature: GZ8MTXP02F5T4T.19.71.G05.1.454.CMB.2.raw
  modified_base (305)..(305): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcagaccctctcgctcacctgtcgccatctccggggacagagtcgctagcgacagtgtgcttggcacgtggtcaggcagtccccatcgagnggtctagagtggctaggggaagacatatttcatcgtccaaacacgtaggaatacaaattatgacacctatctgtagagagtcgactgaacaatacaaacgtagacacatacgaaacgaacctagttcctaccctgacagctacgtacctcgtacgtcgaaccgttcccggaaggtaccgtacggggttagttaacgttaagttacgtaggtacgggaacggaccggtaccccctaagtaaccgg

SEQ ID NO: 430178 - DNA, 570 bp, Homo sapiens
  misc_feature: GZ8MTXP02F1EF1.19.71.G05.1.454.CMB.2.raw
  modified_base (237)..(237): a, c, t, g, unknown or other
  modified_base (314)..(314): a, c, t, g, unknown or other
  modified_base (362)..(362): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaattctttanacagttccaaacaatgaaaactacttagcttggtaccagcagagaccaggacagcctcctaggctgctctatttacnggcatccaccgggaatcccggggtcccctgaccgtattccagtcggcnggccgggtctgggacagtactttcactctcaccatcagcagccctgcgtaggctaggaagagtggtcggtacttagtttaattagttagtacaaactaattatttaattattacgttacggtaggtaccgtttcggaaccgtaaacggggtaaccgtaagggtacgattaacgtccgaagtaacgtaaacgtggtacggcttacgacc

SEQ ID NO: 430179 - DNA, 595 bp, Homo sapiens
  misc_feature: GZ8MTXP02IXJKM.19.71.G05.1.454.CMB.2.raw
  modified_base (244)..(244): a, c, t, g, unknown or other
  modified_base (384)..(384): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacgatacgaactgacaagtccagccacaattcttttaanactacgttaccaacaatacgtaaactactagtcttacggacagacagacgaccaggacacgcctcgagctgctactactttacgcggctactccgtaccggacgtcccggggtcccctacgaccgtatcgagtcggacgngggtcgggtacgtcggactagtactttacactcacacctatacacgacacgccacgcgagacgtagagtagtagtgtagttagtttagttagttagtactaactaattaattaattattacgttacgtacggtacgttacggtacggtaacggtaacgtaacgtacgtaatacgtaacgacgtaacgtacgtacgtacgtacgtacgtacg

SEQ ID NO: 430180 - DNA, 547 bp, Homo sapiens
  misc_feature: GZ8MTXP02GRXIG.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccagtcgagaggtctagagtggctggggaagacatatttcatgtccaaacacgtaggaaataacgaaaatttatagacaccatctgttagagtagtcgactagaacaatacaaacgtagaacacatacgaaagaacctagttcctacctgacagctacgaaccctctcgtacgaccgtcccggaacggtaccgacgggttagtaataacgttacgtaggtacggaaacgtaccggacccccaagtaaccg

SEQ ID NO: 430181 - DNA, 522 bp, Homo sapiens
  misc_feature: GZ8MTXP02HP586.19.71.G05.1.454.CMB.2.raw
  modified_base (240)..(240): a, c, t, g, unknown or other
  modified_base (316)..(316): a, c, t, g, unknown or other
  modified_base (362)..(362): a, c, t, g, unknown or other
  modified_base (420)..(420): a, c, t, g, unknown or other
  modified_base (444)..(444): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaattcttttanacagttccaaacaatgaaaactacttagcttaggtaccagcagagaccaggacagcctctaggctgctcatttacnggcatctacccgggatccggggtcccctgaccgattccagtcggcngggcgggtctggggaccagtatttcactctcaccatcagcagcctgcaggctgaaagntgtggctagtttatatgtacaaanatattattatacttgtacgtacgttcgacctaagggacctagggtacgattagaacgagacgtactgtggcctagacc

SEQ ID NO: 430182 - DNA, 566 bp, Homo sapiens
  misc_feature: GZ8MTXP02INDDV.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccgggacagagtcgctagcgacagtgttgcttggcacgtggtcaggcagtccccatcgagaggtctagagtggcgtgggaagacattatttcatcgtaccaacacgtggaactaacaattatgcacatctgttgagtagtcgactgaacaatcaaacgtagaacacaatacgaaacgaaacctacgttacctacccgtgaccacgtcctacgtacccttcgtacgtacgacccgtaccggacggacgtacgggtgtaatacttacgtggtacggaaacgaccggaccccaagtacgaacctactacgaaccctacccgtcgttcctacgtcggtacgtacgtttaag

SEQ ID NO: 430183 - DNA, 529 bp, Homo sapiens
  misc_feature: GZ8MTXP02G6ZAG.19.71.G05.1.454.CMB.2.raw
  modified_base (230)..(230): a, c, t, g, unknown or other
  modified_base (240)..(240): a, c, t, g, unknown or other
  modified_base (318)..(318): a, c, t, g, unknown or other
  modified_base (349)..(349): a, c, t, g, unknown or other
  modified_base (420)..(420): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgacaagtccagccaanaatcttttanacagttaccaacaatagaaaactacttagcttaggtaccagcagacgaccaggacagcctctaggctgctcatttacngggcatccgtacccgggaatcccggggtccncgaccgattcgagtgcaggcgggtctggggacagtattcactctcaccatcagcagctgcaggctagaagngtgtcggattagtttattagttagactaaataattattaattattacgttgtaggtacgttacggacgaacggacaggtcgatatacaagacgactgagctacgactac

SEQ ID NO: 430184 - DNA, 539 bp, Homo sapiens
  misc_feature: GZ8MTXP02HY5KH.19.71.G05.1.454.CMB.2.raw
  modified_base (235)..(235): a, c, t, g, unknown or other
  modified_base (356)..(356): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanacagttccaacaatagaaaactacttagcttggtaccagcagagaccaggacagcctctaggctgctcatttactggcatcgtacccgggatcccggggtcccctgacccgatcagtggcnggcgggtctggggacagtactttcactctcaccatcagcagccctgcgaggctagaagatggtggtactagtttatattagtacaaactaatattattatactttacgtaggtacgtttacggacgtaaagggacctaaggtaggaatacgtaacgacgtaacgaacgtgtagtacgtcgacc

SEQ ID NO: 430185 - DNA, 513 bp, Homo sapiens
  misc_feature: GZ8MTXP02JZN31.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagaccctctcgctcacctgtgccatcgtccggggacagagtcgctagcgacagtgttgcttggcacgtgggtcaggcagtccccatcgagaggtctagagtggctggggagacatatttcatgtccaaactacggtaggaatacaaattatgacacatactgttgagagtcgactagacaatacaaacgtagacacatacgaagaaccagttctccctagcagctcgacctctgtcgacctacccgacgacgacggtgtataagttacgtaggtacggacgacggaccccagtaacg

SEQ ID NO: 430186 - DNA, 581 bp, Homo sapiens
  misc_feature: GZ8MTXP02F7CN9.19.71.G05.1.454.CMB.2.raw
  modified_base (238)..(238): a, c, t, g, unknown or other
  modified_base (312)..(312): a, c, t, g, unknown or other
  modified_base (360)..(360): a, c, t, g, unknown or other
  modified_base (370)..(370): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccacaatctttanacagttccaacaatgaaaactcttagcttggaccagcagagaccaggacagcctcctaggctgctcatttacgnggcatccgaccggagtccgggtcccctagaccgtatcgaggtcggcgnggcgggtcgngggacagtatttcactctcaccatcagcacgcctgacgaggctagaagtagtggtagtactagtttagtttagttacgtactaaactaaattaattaattaacttacgttacgttacggtacggttaccggtaccggtaaacgggtaacggtaacggtacggtaagtaacgtaacgtaacgtaacgtaacgtacgtacgtacgtacgtacg

SEQ ID NO: 430187 - DNA, 562 bp, Homo sapiens
  misc_feature: GZ8MTXP02JDECV.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgtgcttggcacgtgggtcaggcacgtccccagtcgagaggtctagagtggcgtaggggaagactagtatttcattcgtccaaacgacggtaggaaactaactaaaagtttactagaccaaccatcgtagttgaagtagtcgactagaacaatacaaacgtagaacaacatacgaaacgaacctagttcctacccgtagcacgtactcgacctcgtacgtacgaccgtaccggaacggacgtacgggtataagtaagttacgtaggtacggaacgtaccgaccccagtaacg

SEQ ID NO: 430188 - DNA, 665 bp, Homo sapiens
  misc_feature: GZ8MTXP02G7L5O.19.71.G05.1.454.CMB.2.raw
  modified_base (231)..(231): a, c, t, g, unknown or other
  modified_base (241)..(241): a, c, t, g, unknown or other
  modified_base (250)..(250): a, c, t, g, unknown or other
  modified_base (255)..(255): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgaactgacaagtccagccanaatctttaanacatacaanaatanaaactctagctagacagacagacgaccagacacgtccctacgaggctcgctactacttacgtacggtacgtacgtaccgtaacccggtaaccggtacccggggtacccgtacccgtaccgtacgttacgtacggtacggacgacgggtcgggtacggtacggtacgacgtacttactacctacctaccacctaactacacgacgacgaccgtcgacgacggacgtagtaagtaagtagtagtacgttagtttaattaagttagtaactaaactaaattaattaactttaagttacgttacgttacggtacggttacggtaccggtaaaccggtaaacggtaaacggtaacggtaacgtaacgtaacgtaacgtaaacgtaacgtacggtacggtacgtacgtacgtaccg

SEQ ID NO: 430189 - DNA, 609 bp, Homo sapiens
  misc_feature: GZ8MTXP02I7JFF.19.71.G05.1.454.CMB.2.raw
  modified_base (244)..(244): a, c, t, g, unknown or other
  modified_base (256)..(256): a, c, t, g, unknown or other
  modified_base (261)..(261): a, c, t, g, unknown or other
  modified_base (323)..(323): a, c, t, g, unknown or other
  modified_base (431)..(431): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgaactgacaagtccagccacaatcttttaanactagtaccaanaatanaaactactagtcttacgaccagacagacgaccagacacgcctcgagctgctactatttacgnggactacgtaccgtaacccgggacgtcccgggtacccctacgaccgtattacgaggtcggcgcgggtcggtcgtacgggactagtactttcactcacaccatacgacncacgcgcgacgacgacgtagagagtgtagtagttagttattattagtactaactaattaattattaacttacgttacggttacggtacggttaccggtaaccggtaaacggtaacggtaacggtacggtaagtaacgtaacgtaacgtaacgtaacgtacggtacgtacgtacgtacg

SEQ ID NO: 430190 - DNA, 518 bp, Homo sapiens
  misc_feature: GZ8MTXP02HOI12.19.71.G05.1.454.CMB.2.raw
  modified_base (345)..(345): a, c, t, g, unknown or other
  modified_base (362)..(362): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtcagagtggctgggaagacagtatttcattgtccaaancgtagaataacaattangcacatctgtgagagtcgatgacaatacaaagtagaacacaagtacgaaacgaaccacgttctaccctgacagactcgacctcgtgtacgaccgtccgaacggacgacggggttatataacgttacgaggtacggaacgacggaccccaagtaacg

SEQ ID NO: 430191 - DNA, 691 bp, Homo sapiens
  misc_feature: GZ8MTXP02JJ879.19.71.G05.1.454.CMB.2.raw
  modified_base (225)..(225): a, c, t, g, unknown or other
  modified_base (234)..(234): a, c, t, g, unknown or other
  modified_base (243)..(243): a, c, t, g, unknown or other
  modified_base (247)..(247): a, c, t, g, unknown or other
  modified_base (256)..(256): a, c, t, g, unknown or other
  modified_base (299)..(299): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacatacaanatanaaactatanctgacagcagagacagacagcctctagctgctactatttacgngggactacgtaccgtaacccgggtacgtcccggggtacctaccggaccgtattcgaggtcggaccgacgggcggggttcgtaggggaactagttactttaccgaaccttcctacctaacctaactacgacgacaacgtccgtcgacgaggacgtagaaagtagttcggtacggtacgttaagttttaactttagtttacgtaactaaaacgttaaatttaacgtttaatttaacgtttaaccgtttacggttaacgggttaaccggtttaccgggaaacccggtaaaacggggtaaacccgtaaacggggttaacggtaaacttaacgtaaccggtaaacggtaaaccggtaaacggttacgggtacggtaccgttacggaaccctaacccg

SEQ ID NO: 430192 - DNA, 512 bp, Homo sapiens
  misc_feature: GZ8MTXP02I06JM.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcacgtccccatcgagaggtctagagtggctggggaagcatatttcatgtccaacacgtaggaaatacaaatttatgacacatctgtgagtagtcgatgacaatcaaacgtagacacatacgaagaaccacgttctcctgcagctgacctctcgtgaccgtcccggaggaccgacgggtcgtaataagttacgtggtacggaacgtacggaccccagtaacg

SEQ ID NO: 430193 - DNA, 534 bp, Homo sapiens
  misc_feature: GZ8MTXP02JOWC1.19.71.G05.1.454.CMB.2.raw
  modified_base (242)..(242): a, c, t, g, unknown or other
  modified_base (310)..(310): a, c, t, g, unknown or other
  modified_base (317)..(317): a, c, t, g, unknown or other
  modified_base (427)..(427): a, c, t, g, unknown or other
  modified_base (445)..(445): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccgatcgaactgacaagtccagccacaattctttanacagttccaaacaatgaaaactacttagcttggaccagcagagaccaggacagcctcctaggctgctnatttacngggcatccgtacccgggaatcccggggtcccctgacccgattcgagtcggcaggcggggtctaggggacagtatttccactctcaccatcagcagcctgcaggctgaaantgtgctagtttatagttnacaaatattattattatactgtcggtaacgttcggaccgtaaaggaccaaggttacggatagtcgaagaccgtaatggtacggctgacc

SEQ ID NO: 430194 - DNA, 604 bp, Homo sapiens
  misc_feature: GZ8MTXP02GBAMV.19.71.G05.1.454.CMB.2.raw
  modified_base (237)..(237): a, c, t, g, unknown or other
  modified_base (313)..(313): a, c, t, g, unknown or other
  modified_base (360)..(360): a, c, t, g, unknown or other
  modified_base (421)..(421): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacgnggcatcgtaccggactccgggtcccctgaccgtattcgaggtcggcnggcgggtcgtgggacagtactttcactctacaccatcagcacgcctgcgaggctagaaagngtggtacggtacttagtttaattagttacgtaactaaaactaaatttaatttaattaacgttacgtttacggtacgggtaaccggtttaccgggaaccgtaaaaggggtaacccgtaaaggggttacggtaattaacgtaaccgaacggtaaacgtaaacgtacggtacggtacgtacgtacg

SEQ ID NO: 430195 - DNA, 550 bp, Homo sapiens
  misc_feature: GZ8MTXP02IYNKO.19.71.G05.1.454.CMB.2.raw
  modified_base (238)..(238): a, c, t, g, unknown or other
  modified_base (401)..(401): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttaggtaccagcagagaccaggacagcctcctaggctgctctatttactgggcatccgtacccgggaatccggggtcccctgacccattcgagtggcaggcgggtctgggaccagtatttcactctcacctancagcagccctgcaggctagaagatgtcggtactaggtttatattgtactaaataattattaattagtacttacgtagtacgttacggaccaaagggtaccgaaggtcggaatagtaacgaacggacgtaaactggtacggactcgaacc

SEQ ID NO: 430196 - DNA, 561 bp, Homo sapiens
  misc_feature: GZ8MTXP02I521O.19.71.G05.1.454.CMB.2.raw
  modified_base (235)..(235): a, c, t, g, unknown or other
  modified_base (243)..(243): a, c, t, g, unknown or other
  modified_base (247)..(247): a, c, t, g, unknown or other
  modified_base (256)..(256): a, c, t, g, unknown or other
  modified_base (299)..(299): a, c, t, g, unknown or other
  modified_base (392)..(392): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgactgacaagtcagcacatctttanacatcaanatanaaactatanctagacagacagagacagacagcctcagctgctctatttacgnggactacgtaccgtacccgggaacgtcccggggtcccctagaccgtattcgaggtcggacgaggtcgggtcgtagggacagtactttcactcncaccatcacgcgacgcctcgcgacgacgtagagtagtgtagtagtagtttattattatactaactaattaattattaattacgttacgttacggtacgttacggtacgtaacggaacgtaacggtacggtagtagtaacgacgaacgtacgtagtacgtacgtacgacg

SEQ ID NO: 430197 - DNA, 585 bp, Homo sapiens
  misc_feature: GZ8MTXP02GY3WF.19.71.G05.1.454.CMB.2.raw
  modified_base (378)..(378): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatccgtccggggacagacgtcgctagcgacagtgtgcttggcacgtgggtcaggcacgtccccatcgagagtctagagtggcgtagggaagacagtatttcattcgtccaaacgacgtaggaaaactaacgtaaaatttntacgaccaacctaattcgttgttagaagtagttacgaactagaacaactacgaaaacgtagaacaacgtataacgaaacgaacctacgttacctacccgtgacacgctacgacccttcgtcgtacgaccgtaccccggaaggtaccgtacgggttagttacgtaacgttacgtaggttacggaacgaccggaccccctagtaaaccg

SEQ ID NO: 430198 - DNA, 538 bp, Homo sapiens
  misc_feature: GZ8MTXP02IH82O.19.71.G05.1.454.CMB.2.raw
  modified_base (346)..(346): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagagtctagagtggctaggggaagacagtatttcatgtccaanacgtagaaataacaaatatgacacatctgttgagtagtcgactagacaatacaaacgtagacaacatacgaaagaaccagttacctaccctagacagctacgaccctctagtcggaacctccccggaaggtaccgacggggttactagtaacttacgtaggtacgggaaacgaccggaccccctaagtaacg

SEQ ID NO: 430199 - DNA, 540 bp, Homo sapiens
  misc_feature: GZ8MTXP02JBBPI.19.71.G05.1.454.CMB.2.raw
  modified_base (412)..(412): a, c, t, g, unknown or other
  modified_base (468)..(468): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagaggtctagagtggctggggaaggacagttatttcattgtaccaaacacggtaggaaactaacaaaatttatcgacaaccatcttgttgagagtcgaactgaacaatacaaacgtagacacaatacgaaanaacctagttccacctgacagctgacctctgtacgacctccggaggacgacgggttntatagttacgtggtaggaacggacggaccccaatacgacagtcgaacctactcgtctcgtggtcgactttag

SEQ ID NO: 430200 - DNA, 757 bp, Homo sapiens
  misc_feature: GZ8MTXP02GXZ1A.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatcgtccggggacagagtcgctagcgacagtgtgcgttggcacgtgggtcagggcacgtccccagtcgagaggttcaggagtggctaggggaaagactagttatttcgaattcgtaccaaacgtacggttagggaaaacttaacgtaaaaatttacgtacggaccctaaacctaacttacgttacgggtttaggaaacggtaacggtttaccggaaacctttacgggaaaacctaaaacttaccggtaaaaaccggttaaccggaaaaccgaacctaaaacgttaacccgggaaaaacgggtaaaccccttaacggtttaaccccttaccccgttacggaacccttaacggaccctttacgggaaacccctttaccgttcgggttaccgtaaacccggttaccccggggaaacgggtacccggtaaccgggggttactttaaagtttaacgtttaaccggttagggttaaacggggtaaaccggaaccggtaccccccgtaaagtttaaacccggg

SEQ ID NO: 430201 - DNA, 622 bp, Homo sapiens
  misc_feature: GZ8MTXP02FWK43.19.71.G05.1.454.CMB.2.raw
  modified_base (235)..(235): a, c, t, g, unknown or other
  modified_base (244)..(244): a, c, t, g, unknown or other
  modified_base (252)..(252): a, c, t, g, unknown or other
  modified_base (256)..(256): a, c, t, g, unknown or other
  modified_base (264)..(264): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctggggcgagccggggcctacggactacgacgtgactaaggtccagccanaatctttanacatcaanatanaaatctanctagacagcagagacagacacgctctacgctctctactacttacgtggctactaccgtaccggtacggtccggtccccgtacgtaccgtacgtacgtacgtgacgcggcggtcgtacggacgtagtacttactactctaccacctactacacgacgacgcctacgacgacggacgtacgaaaggtagtaggtacggtacgttaagtttgtttaagttacgttaacgtaaacttaaattaattaattaacttacgtttacgttacggttacggttaccggtaccggtaaacggtaaacggtaacggtacggtaagtaacgtaacgtaacgtaacgtaacgtagtacgtacgtacgtacg

SEQ ID NO: 430202 - DNA, 519 bp, Homo sapiens
  misc_feature: GZ8MTXP02G4ECD.19.71.G05.1.454.CMB.2.raw
  modified_base (392)..(392): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctaggagtggctaggggaagacatatttcatcgtaccaacacgtaggaaactacaaattatagcaccatctgttgagagtcgactgacaatacaaacgtagacanatacgaagaacctagttacctccctgacagctcgacctctgtacgacctcccgaggacgacgggtgtatattactgtaggaagacggaccccatacgacatcgccactcgtctcgtggtctacttag

SEQ ID NO: 430203 - DNA, 518 bp, Homo sapiens
  misc_feature: GZ8MTXP02IYPSM.19.71.G05.1.454.CMB.2.raw
  modified_base (238)..(238): a, c, t, g, unknown or other
  modified_base (411)..(411): a, c, t, g, unknown or other
  modified_base (417)..(417): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactacttagcttggtaccagcagagaccaggacagcctcctagctgctcatttactggcatctacccggaatccggggtcccctgaccgattcagtggcagcgggtctgggacagatttcactctcaccatcagcagcctgcaggctgaaagtntgtgtntagttattattagtataactaataattattatattacgtcgtacgtacgacgaacggacgaacgtagtagtataagacgacgaactagtacgtcgtacgcg

SEQ ID NO: 430204 - DNA, 574 bp, Homo sapiens
  misc_feature: GZ8MTXP02HBR7D.19.71.G05.1.454.CMB.2.raw
  modified_base (239)..(239): a, c, t, g, unknown or other
  modified_base (315)..(315): a, c, t, g, unknown or other
  modified_base (366)..(366): a, c, t, g, unknown or other
  modified_base (398)..(398): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccacaattctttanacagttccaaacaatgaaaactcttagcttggaccagcagagaccaggacagcctctaggctgctctatttaccgnggactacgtccgtacccgggagtccgggtcccctgaccgtatcgagtgcgnggtcggtcgaggactagtacttcactctcacntcagcacgctgacgagactagaagtgtggtggtacttagtttattagtacgtaactaaattaattatttaattacttacgttacggtacggtacggttacggaaccgtaaagggtaccgtaagggtacgtaataacgtaacgtaacggtaacgtaacgtggtacggtacgtacgac

SEQ ID NO: 430205 - DNA, 540 bp, Homo sapiens
  misc_feature: GZ8MTXP02F29KL.19.71.G05.1.454.CMB.2.raw
  modified_base (229)..(229): a, c, t, g, unknown or other
  modified_base (236)..(236): a, c, t, g, unknown or other
  modified_base (247)..(247): a, c, t, g, unknown or other
  modified_base (309)..(309): a, c, t, g, unknown or other
  modified_base (333)..(333): a, c, t, g, unknown or other
  modified_base (349)..(349): a, c, t, g, unknown or other
  modified_base (356)..(356): a, c, t, g, unknown or other
  modified_base (408)..(408): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccacgatcgaactgcaagtccagccanatcttanacagttccaanatgaaaactcttagcttggtaccagcagagaccaggacagcctctaggctgctcatttacgnggctatcgaccggatccggtcccngaccgtatcagtcgcnggcggtntgggactagtatttcactctacaccatcagcacgcctgacgaggctagaagngtggtacggtactagtttattagtcgtactaaactattattattatacgttgtaggtacgttcggacgtaaaggtacctaagggtacgtattacgtaacgaacggtaacgtaacgtggtcgacgtacgtacc

SEQ ID NO: 430206 - DNA, 577 bp, Homo sapiens
  misc_feature: GZ8MTXP02FP1PX.19.71.G05.1.454.CMB.2.raw
  modified_base (227)..(227): a, c, t, g, unknown or other
  modified_base (237)..(237): a, c, t, g, unknown or other
  modified_base (372)..(372): a, c, t, g, unknown or other
  modified_base (377)..(377): a, c, t, g, unknown or other
  modified_base (381)..(381): a, c, t, g, unknown or other
  modified_base (405)..(405): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccanaatcttttanacagttccaaacaatagaaaactactagcttaggtaccagcagagaccaggacagcctctaggctgctcattactgggcatccgtaacccggggaatcccggggtcctcgaccgattcaggtgccaggcgggtcnggganagtnttcactctcacatcagcagtccgngcgaggctagaagtagtggtacgtacttagttttaattacgttagtaactaaataattaatttaattagttacgttcggtacggtacggttacggacggtaaacgggtaacgtaaaggtagtaactaacgtacgaacgtaacgtaacgtacggtacggtctacgacctaacg

SEQ ID NO: 430207 - DNA, 519 bp, Homo sapiens
  misc_feature: GZ8MTXP02IXC1G.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcacgtccccatcgagaggtctagagtggctggggaacgacatatttcatgtaccacacgtaggaaatacaaattatgacaccatctgttgagagtcgactgacaatacaacgtagacaacatacgaacgaacctagttcctaccctgcacgctcgacctcgtcgtcgaccgtcccggaggaccgtacgggtagtaactagttaacgtgtacggacgacggacccctatacgac

SEQ ID NO: 430208 - DNA, 607 bp, Homo sapiens
  misc_feature: GZ8MTXP02JLU7D.19.71.G05.1.454.CMB.2.raw
  modified_base (238)..(238): a, c, t, g, unknown or other
  modified_base (314)..(314): a, c, t, g, unknown or other
  modified_base (345)..(345): a, c, t, g, unknown or other
  modified_base (349)..(349): a, c, t, g, unknown or other
  modified_base (356)..(356): a, c, t, g, unknown or other
  modified_base (387)..(387): a, c, t, g, unknown or other
  modified_base (392)..(392): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacgnggcatcgaccggacgtccggcccctgacctntcgngtcgcgnggtcgggtcgtgggacagtactttcactccncaccntcagcacgcctgcgaggctagaaagtgttggtcggtacttagttttattagttacgtaactaaacttaatttaatttaacgtttaacgttacgtttcggtaacgggttaccggtttaccgggaaaccggtaaacggggtaaccgtaaaggggttacggtaaacttaacgtaacggtaaacggtaaaccgtaacgtggtacggtccgtacgaaccg

SEQ ID NO: 430209 - DNA, 617 bp, Homo sapiens
  misc_feature: GZ8MTXP02HHJJ1.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagacgtcgctagcgacagtgtgcttggcacgtgggtcaggcacgtccccagtcgagagtctagagtggcgtggggaagacattatttcatcgtccaaacgtacgtagaaattaacaaattatgacactatctgtgagtagtacgactagaacaatacgaaacgtagaacaactaatagaaacccccccgtaaatacgttacctacccgtacgacgacgtaccgtacgtaacccttcgtacggttaccgtaacccgtaccccggaaacgggtaccggtaaccggggttaacgttaacgttaaacgtttaaccggttacggttacggggaaaaccggtacccggaaccccccgtaagttaaacccgg

SEQ ID NO: 430210 - DNA, 569 bp, Homo sapiens
  misc_feature: GZ8MTXP02IZCV0.19.71.G05.1.454.CMB.2.raw
  modified_base (245)..(245): a, c, t, g, unknown or other
  modified_base (247)..(247): a, c, t, g, unknown or other
  modified_base (249)..(249): a, c, t, g, unknown or other
  modified_base (258)..(258): a, c, t, g, unknown or other
  modified_base (265)..(265): a, c, t, g, unknown or other
  modified_base (270)..(270): a, c, t, g, unknown or other
  modified_base (301)..(301): a, c, t, g, unknown or other
  modified_base (355)..(355): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccaccatcaactgcaagtccagccacaatcttttaaacatacaanananaaactatanctgacancaganacagacacgcctctagctgctctatttacgnggcactccgtaacccggacgtcccgggtcccctagaccgtatacgaggtggcgngggcgggtctacgggacagtactttcactcaccaacatacagcacgcctgacgaggctagaaagagtggtacgtacgttaagtttattattacgtaactaaaactaattaatttaattaattacgttacgtacggtacgttccggaacgtaaagggtaaccaagggttacgaataagtaacgaagtaaccgtaaacgtggtacgacgtacgacc

SEQ ID NO: 430211 - DNA, 548 bp, Homo sapiens
  misc_feature: GZ8MTXP02HKB3T.19.71.G05.1.454.CMB.2.raw
  modified_base (241)..(241): a, c, t, g, unknown or other
  modified_base (252)..(252): a, c, t, g, unknown or other
  modified_base (314)..(314): a, c, t, g, unknown or other
  modified_base (357)..(357): a, c, t, g, unknown or other
  modified_base (385)..(385): a, c, t, g, unknown or other
  modified_base (410)..(410): a, c, t, g, unknown or other
  modified_base (412)..(412): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccacgatacgaactgcaagtccagccacaatctttanacagttccaanaatagaaaactactagcttggaccagcagagaccaggacagcctctaggctgctcatttacngggcatccgtaccgggaattcgtccggggtcccctgacccgtnttacgagttggcagcggggtctgggacngactttcacttcacaccatcagcancngcgagcagagatgtgtgtagttattattagtactaataatattaattattacgttacgtacggtacggttacggtaccgtaacggtaaccgacggtaggtagtaagttacgtaagacgaacgtacgtacgtagtcg

SEQ ID NO: 430212 - DNA, 572 bp, Homo sapiens
  misc_feature: GZ8MTXP02I6VXK.19.71.G05.1.454.CMB.2.raw
  modified_base (240)..(240): a, c, t, g, unknown or other
  modified_base (379)..(379): a, c, t, g, unknown or other
  modified_base (434)..(434): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaattcttttanacagttaccaaacaatagaaaactcttagcttggtaccagcagagaccaggacagcctctaggctgctctatttacgggcatccgtaacccgggatcccccggggtcctgaccgtattcgaggtggcgaggccggggtntgggactagtactttcactctacaccatcagcacgcctgacaggctaggaaagtntggtggctagttttaatagttagtactaataattatttaatattaccgttaggtcggtacggttccggaaccgtaaacggggtacctaaaggggtgtaaattaagccgtaaggaaccgtaagtcggttaggcttacgg

SEQ ID NO: 430213 - DNA, 637 bp, Homo sapiens
  misc_feature: GZ8MTXP02JPFKL.19.71.G05.1.454.CMB.2.raw
  modified_base (246)..(246): a, c, t, g, unknown or other
  modified_base (330)..(330): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccggccaccatcaactgacaagtccacgccaactaattcttttaanactagttaccaaacaatagaaaactactagcttggaccagcaagacgaccaggacacgcctaccgtaggctgctctatttacgnggactactccgtaacccggggaacgtcccggggtcccctcggacccgtattccgaggtcggccgaggggtccggggtctaggggactaggtactttcactctcaaccatcagcacgcctgcaggctaaggaagtgttggtacggtattaaggttttattaagttgaacctaaaattaatttatttaatttaacgttacgtttacggttacgggtaccggttacgggaacccggtaaaagggaccgtaaacgggtacggtaattaacgtaaccgaagtaaaccggtacgtggttacgcgtacaacccg

SEQ ID NO: 430214 - DNA, 586 bp, Homo sapiens
  misc_feature: GZ8MTXP02F88J7.19.71.G05.1.454.CMB.2.raw
  modified_base (231)..(231): a, c, t, g, unknown or other
  modified_base (240)..(240): a, c, t, g, unknown or other
  modified_base (249)..(249): a, c, t, g, unknown or other
  modified_base (253)..(253): a, c, t, g, unknown or other
  modified_base (259)..(259): a, c, t, g, unknown or other
  modified_base (262)..(262): a, c, t, g, unknown or other
  modified_base (304)..(304): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgatacgactgactaagtcagccanaatctttanacatacaanatanaaactntantgacagcagacgacagacagcctcgagctgctactattacgnggactacgtccgaccggtacgtcccggggtacccctacgaccgtatacgaggtcggacgcgggtcgggtcgtacgggactagtactttccactccactaccactacgacgacgacgcctcgcgacgacgtagagtagtaggtacgtacgttagtttagttattagtactaactaattaattattagttacgttacgttacggtacggtacggtaccggtaacggtaacggtacggtacgtagtacgtaacgacgaacgtacgtacggtcgtacgtacgtacg

SEQ ID NO: 430215 - DNA, 533 bp, Homo sapiens
  misc_feature: GZ8MTXP02FXK6W.19.71.G05.1.454.CMB.2.raw
  modified_base (241)..(241): a, c, t, g, unknown or other
  modified_base (312)..(312): a, c, t, g, unknown or other
  modified_base (363)..(363): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgacaagtccagccacaatctttanacagttccaacatagaaaactactagctgtaccagcagagaccaggacagcctctaggctgctcatttacngggcatctaccgggatccccggggtcctgaccgattcagtggcaggcggtntggggacagactttcactctacacatcagcacgccgtagcgacgctagaagagtggtggacttagtttattagttgtaactaataattattattattacttacggtgtacgttcggacgaacgggacctaaagggtgtaataagtacgaacgtacgaacgtgtggctacg

SEQ ID NO: 430216 - DNA, 559 bp, Homo sapiens
  misc_feature: GZ8MTXP02HNQCW.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccatacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatctccggggacagagtcgctagcgacagtgttgcttggcacgtgggtcaggcacggtccccatcgagaggtctagagtggctaggggaaggacatatttcattgtccaaacgacgtaggaataacaaattatagaccaccattctgttagacgagtaccgactagaactaatcaaacgtagacaacagtacgaaacgaaacctacgttcctaccctgacacgtcctgaaccctcgttcgtacgaccttcccggaaggaccgtacggggttagtattaacgttacgtaggtacggaacgaccggtacccccaagtaacg

SEQ ID NO: 430217 - DNA, 593 bp, Homo sapiens
  misc_feature: GZ8MTXP02FOO48.19.71.G05.1.454.CMB.2.raw
  modified_base (239)..(239): a, c, t, g, unknown or other
  modified_base (317)..(317): a, c, t, g, unknown or other
  modified_base (371)..(371): a, c, t, g, unknown or other
  modified_base (404)..(404): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaacaatagaaaactacttagcttaggtaccagcagagaccaggacagcctcctaggctgctcatttacgngggcatccgtacccgggaatcccggggtccccctgacccgtattcgagtcggcnggcgggtctggggacagtatttcactctcaccntcagcacgccctgcaggctaggaaagtgtgtggacttaggttttaacttattagtactaaataattatttaattattaaccgttgtacggtaaccgtttcggaacccgtaaaaggggtaccctaaaggggtcggaaatttaacgtaaccgaaaggtaacgtaaacgttggttagggaccttggtaaccc

SEQ ID NO: 430218 - DNA, 510 bp, Homo sapiens
  misc_feature: GZ8MTXP02FS1FM.19.71.G05.1.454.CMB.2.raw
  modified_base (310)..(310): a, c, t, g, unknown or other
  modified_base (352)..(352): a, c, t, g, unknown or other
  modified_base (366)..(366): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcaagcgggcaccatcaactgcaagtccagccacaatctttatacagttccaacaatgaaaactacttagcttggtaccagcagagaccaggacagcctcctaggctgctcatttacnggcatctaccgggatccggggcccctgaccgattcagtggcngcgggtctgggacngatttcactctcaccatcagcagcctgcaggctgaagatgtggctagtttatattgtacaacaattattaattatacttcggtaggtacgttcggaccaaaggggaccaaagggtgatatcgaagacgaactggtaggctgacc

SEQ ID NO: 430219 - DNA, 529 bp, Homo sapiens
  misc_feature: GZ8MTXP02I5S5R.19.71.G05.1.454.CMB.2.raw
  modified_base (481)..(481): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtcagagtggctggggaagacatatttcattgtccaacacgtgaatacaaattatgacaccatctagttgagtagtcgactgacaatcaaacgtagacactatacgaaagaacctagttcctaccctgacagctagacccttctggtacaccgtacccgaaggacctacggggttntaagttaacgttacgtggtacggaacgtaccggaccccctaagtaacg

SEQ ID NO: 430220 - DNA, 583 bp, Homo sapiens
  misc_feature: GZ8MTXP02GNL7B.19.71.G05.1.454.CMB.2.raw
  modified_base (241)..(241): a, c, t, g, unknown or other
  modified_base (318)..(318): a, c, t, g, unknown or other
  modified_base (375)..(375): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttanacagttccaacaatagaaactcttagcttggaccagcaagagaccaaggacacgcctcctaggctgctcatttacgnggctacgtaccgtaccggacgtcccgggtcccctagaccgtattcgaggtcggacgngggccgggtcgtacgggactagtactttcactctacacatcagcacgcctgcgagactagaagtagtggtgtattagtttattattacgtactaaataattaattattaagttacgttcggtacggtacggttaccggaaccggtaaacgggtaaccgtaaggtacgaatagtaacgaacgtaacgtacgtggtacggcgtacgtacg

SEQ ID NO: 430221 - DNA, 630 bp, Homo sapiens
  misc_feature: GZ8MTXP02JRY0F.19.71.G05.1.454.CMB.2.raw
  modified_base (246)..(246): a, c, t, g, unknown or other
  modified_base (255)..(255): a, c, t, g, unknown or other
  modified_base (259)..(259): a, c, t, g, unknown or other
  modified_base (265)..(265): a, c, t, g, unknown or other
  modified_base (268)..(268): a, c, t, g, unknown or other
  modified_base (301)..(301): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggcctacggactacggacgtcgactaaggccagccacatctttanacatacaanatanaaactntanctagacagacagacgacagacacgctctacgcncgctctacttacgtcggtactactacgtaccggtacggtaccggtccccgtacgacgtacgtacgtacgtcgcgcggcgggtcggtacggacgacgtacttactactactaccactactacacgacgacgaccgtacgacgacgacgtacgaagtagtaggtacgtacgttagtttagtttagttacgtaactaaactaaattaattaattaacgttacgttacgttacggttacggttaccggtaaccggtaaacggtaaacggtaacggtacggtaacgtaacgtaacgtaacgtaacggtaacgtacggtacggtacgtacgtacg

SEQ ID NO: 430222 - DNA, 600 bp, Homo sapiens
  misc_feature: GZ8MTXP02FHAEP.19.71.G05.1.454.CMB.2.raw
  modified_base (235)..(235): a, c, t, g, unknown or other
  modified_base (311)..(311): a, c, t, g, unknown or other
  modified_base (430)..(430): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcacatcaactgcaagtccagccacaatctttanacagttccaacaatgaaaactacttagcttggtaccagcagagaccaggacagcctcctaggctgctcatttacgnggcatccgaccgggacgtccggggtcccctgaccgtattcgaggtcggacgcggccgggtcgtggggactagtactttccactctacaccatcagcacgcctgacgaggactagaaagngtggtggtacttagttttaattagttacgtaactaaacttaaatttaatttaattaactttacgttacggtacggtaccggttaccggaaccgtaaacggggtaaccgtaaaggggtacggtaattaacgtaacgaaggtaaaccgtaacgtaggtacggcgtacgaccg

SEQ ID NO: 430223 - DNA, 622 bp, Homo sapiens
  misc_feature: GZ8MTXP02GEDJG.19.71.G05.1.454.CMB.2.raw
  modified_base (240)..(240): a, c, t, g, unknown or other
  modified_base (251)..(251): a, c, t, g, unknown or other
  modified_base (255)..(255): a, c, t, g, unknown or other
  modified_base (264)..(264): a, c, t, g, unknown or other
  modified_base (374)..(374): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttaanacagtaccaanatanaaactctanctagacagacagacgaccagacacgtcctcgtagctgactctatttacgcggactacgtaccgtaaccgggtacgtcccgggtcccctaggacctattcgaggtcggcgnggtcgggtcgtaggactagtactttccacttcctacaaccgatacacgacgacgaccgtcgacgacgtacgtagtaagtagtaggtaggtacgttagtttaagtttagttacgttaactaaactaaattaatttaattaacttacgttacgttacggtacggttacggtaaccggtaaacggtaaacggtaacggtaacggtaagtagtaacgtaacgtaacgtacgtaggtacggtacgtacgtacg

SEQ ID NO: 430224 - DNA, 631 bp, Homo sapiens
  misc_feature: GZ8MTXP02IXDH1.19.71.G05.1.454.CMB.2.raw
  modified_base (239)..(239): a, c, t, g, unknown or other
  modified_base (315)..(315): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaattctttanacagttaccaaacaatgaaaactcttagcttgtaccagcagacgaccaggacagcctctaggctgctcatttacgngacacgtaccgtaccggagtccggtaccctacgaccgtatcgagtcggacgagggtcgggtacgtacgggactagtactttaccacctcctaccaaccctatacgaacgcgacgtaccgtacgacgacgacgtagtaaagtagttacggtacggtagttagtttaatttagttacgtaactaaactaaattaaatttaatttaattacgttacggttacggtacggttaccggtaaccggtaaacggtaaacggtaacggtaacggtaacgtaacgtaacgtaacgtaacgtaacgtacgtacgtacgtacgtacg

SEQ ID NO: 430225 - DNA, 613 bp, Homo sapiens
  misc_feature: GZ8MTXP02H7K13.19.71.G05.1.454.CMB.2.raw
  modified_base (229)..(229): a, c, t, g, unknown or other
  modified_base (238)..(238): a, c, t, g, unknown or other
  modified_base (317)..(317): a, c, t, g, unknown or other
  modified_base (459)..(459): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgccccacggggacatcgtgatgacccagtctccagactccctggctgtgtctcgtgggcgagcgggccaccgatcaactgacaagtccagccanaatctttanacagttacaacaatagaaaactacttagcttaggtaccagcagagaccaggacagcctcctaggctagctcaatttacngggctagtccgtaacccggggaatcccggggtcctacgaccgtattcgaggttggacgaggtcgggggtccttaggggaacctaggtaactttcaacttcctacaccctaatcaagcacgcccgtgcgaggtctagaaagtntggtacgggacttagttttattagttacgtaacaaactaaatttattaatttataccgtttagtacggtacgtttacggaccgtaaacgggaacctaaaggttcggaacttagacgtaacggaacgtaaactggtacggctacggacctaaccg

SEQ ID NO: 430226 - DNA, 634 bp, Homo sapiens
  misc_feature: GZ8MTXP02G6EM2.19.71.G05.1.454.CMB.2.raw
  modified_base (230)..(230): a, c, t, g, unknown or other
  modified_base (239)..(239): a, c, t, g, unknown or other
  modified_base (251)..(251): a, c, t, g, unknown or other
  modified_base (256)..(256): a, c, t, g, unknown or other
  modified_base (313)..(313): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcaactgacaagtccagccanaatctttanacacgtaccaanaatanaaactctagtctagacagcagacgacagacacgcctacgagctgctactatttacgnggactacgtaccgtacccgggacgtcccgggtcccctagaccgtattcgaggtcggacgcgggtcgggtacgacgggactagttactttacacctctaccactactacgacgacgtacgtccgtcgacgacggtactaaggaaagtgtaggtacggtacttagttttattagttacgtaactaaataaatttatttaacgttaactttacgttacggttacggttaccggttacggaaccggtaaacgggtaaacgtaagggttacgtaaacgtacgtaacgtaaacgtaaacgtacgtacggtccggtacgtacgtaccg

SEQ ID NO: 430227 - DNA, 580 bp, Homo sapiens
  misc_feature: GZ8MTXP02GIUIO.19.71.G05.1.454.CMB.2.raw
  modified_base (238)..(238): a, c, t, g, unknown or other
  modified_base (247)..(247): a, c, t, g, unknown or other
  modified_base (251)..(251): a, c, t, g, unknown or other
  modified_base (257)..(257): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactcgataagtccagcacatctttanacatacaanatanaaactntagctagaccagacagacgaccaggacacgcctcgtaggctgtctctattacgtcggtactacgtacgtaccggtacgtccccgggtccgtacgacgtactacgtacggtcggcgacggcgggtcgtacggacgtacgtacttactactacctacaccactacacgacgacgcgtacgacgacgacgtagaagtagtagtagtacgttagttattagttacgtactaactaattattattattacgttacgtacggtacggtacggtacggtaacggacgtacggtagtagtaagtacgacgacgacgtacgtacgtacgtcg

SEQ ID NO: 430228 - DNA, 512 bp, Homo sapiens
  misc_feature: GZ8MTXP02FSTQ0.19.71.G05.1.454.CMB.2.raw
  modified_base (316)..(316): a, c, t, g, unknown or other
  modified_base (444)..(444): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactggtcaggcagtccccatcgagaggtcagagtggctgggaagacatattcatgtccaanacgtggaatacaaattatgcaccatctgttgagtagtcgaactgaacaatcaaacgtagacacatacgaagaaccagttctaccctgcagctcgacctctacgtgaccgtcccgaggactacggggtntatagttactgtgggaaagacggccccaagtacgaccatacgcctactccgtctctggtcgtcttaag

SEQ ID NO: 430229 - DNA, 507 bp, Homo sapiens
  misc_feature: GZ8MTXP02HC0W4.19.71.G05.1.454.CMB.2.raw
  modified_base (237)..(237): a, c, t, g, unknown or other
  modified_base (313)..(313): a, c, t, g, unknown or other
  modified_base (356)..(356): a, c, t, g, unknown or other
  modified_base (411)..(411): a, c, t, g, unknown or other
  modified_base (414)..(414): a, c, t, g, unknown or other
  modified_base (498)..(498): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactacttagcttggtaccagcagagaccaggacagcctcctaggctgctcatttacnggcatcgtaccggaatccggggtcccctgaccgattcagtgcngcgggtctgggacagtatttcactctcaccatcagcagcctgcaggctagaaagntgnggtcagtttatattgacaatatattattaatcttcgtgtacgttcggactaaagggaccaaggtcgattagcgagacgaactgnggactcgac

SEQ ID NO: 430230 - DNA, 579 bp, Homo sapiens
  misc_feature: GZ8MTXP02HBOBP.19.71.G05.1.454.CMB.2.raw
  modified_base (238)..(238): a, c, t, g, unknown or other
  modified_base (315)..(315): a, c, t, g, unknown or other
  modified_base (364)..(364): a, c, t, g, unknown or other
  modified_base (423)..(423): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttggtaccagcagagaccaggacagcctctaggctgctcatttacgnggcatcgtaccccgggaatcccggggtcccctgacctattcaggtggcnggccgggtctggggacagtactttcactctcaccatcagcagcctgcaggctagaaagntggtcggtactagttttatattgtactaaactaattattaattacttacgttcggttacggtaccgtttacgggacccgtaaaggggacctaaaggggtcggtaattaacgtaaccgaaaggtaacccgtaaaacgttggacggtacctagaaccc

SEQ ID NO: 430231 - DNA, 607 bp, Homo sapiens
  misc_feature: GZ8MTXP02H33OQ.19.71.G05.1.454.CMB.2.raw
  modified_base (245)..(245): a, c, t, g, unknown or other
  modified_base (327)..(327): a, c, t, g, unknown or other
  modified_base (379)..(379): a, c, t, g, unknown or other
  modified_base (407)..(407): a, c, t, g, unknown or other
  modified_base (415)..(415): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccaccatcaactgcaagtccagcccaataattcttttaanacagttaccaaacaatagaaaactctagcttaggtaaccagcaagagaccaggacacgccttccaggctgctacatttacgnggacatccgtaacccgggaatccggggtcccctgaccgtattcgagtggacnggcgggtctgggacagtactttcactcnccaactancagcacgtcctagacgacgtacgtaagaaagtgtaggtaggtaacttaggtttaatagttaagaaactaaaattaattaatttaacttacgttaacgttcggtaacgggtacgttacggaacggaaacggggtaacgtaaaggtacgtaactagtaacgaacggtaaacgtaacgtggtacgtactacgacc

SEQ ID NO: 430232 - DNA, 608 bp, Homo sapiens
  misc_feature: GZ8MTXP02INS8D.19.71.G05.1.454.CMB.2.raw
  modified_base (246)..(246): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctggggcgaggcgggccaccgatacgaactcgacaaggtccagccacaatcttttaanactacgttaccaactaatagtaaaactactagtcttaggtaccagacagacgaccgaggacacgcctacgtaggctcgctactactttacgtcggactacgtccgtacccggggtaacgtcccgggtcccctacgaccgtattcgagtcggacgcgggtccgggtcgtacgggactagtactttcactctacaccatacacgacacgcctgacacggctagaagtgtggtacggtacttagtttattatagtactaataattattattaactacgttacgtacggtaccgttacggaccggtaaacgggtacgtagggttacgtaactacgtaacgaacgacgtacgtgtacgtctacgacg

SEQ ID NO: 430233 - DNA, 561 bp, Homo sapiens
  misc_feature: GZ8MTXP02ICL66.19.71.G05.1.454.CMB.2.raw
  modified_base (243)..(243): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccggggccaccgatcgaactgacaagtccagccacaatcttttanacagttaccaaacaatagaaaactactagcttaggtaccagcagagaccaggacacgcctcctaggctagctcaatttacgtgggcacgtccgtaacccgggaagtcccggggtacccctgaccgattcgagtcggcagcgggtctgggacagtatttcactctcacctatcagcagcctgacaggcagaagagtgtggtatagtttatattagactaaactaattattaattactacgttacgtaggtaccgtttcgggactaacgggaaccaacgggtacggtaatagtaacgagaagaacgtgtggactgacccg

SEQ ID NO: 430234 - DNA, 620 bp, Homo sapiens
  misc_feature: GZ8MTXP02FS6F9.19.71.G05.1.454.CMB.2.raw
  modified_base (230)..(230): a, c, t, g, unknown or other
  modified_base (237)..(237): a, c, t, g, unknown or other
  modified_base (246)..(246): a, c, t, g, unknown or other
  modified_base (250)..(250): a, c, t, g, unknown or other
  modified_base (256)..(256): a, c, t, g, unknown or other
  modified_base (259)..(259): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgactacgacgtgactaagcagcanatcttanacatacaanatanaaactntanctgacagacagacgacagacacgcctcgtacgctcgtctactacgttacgtacggacgtacgtaccgtaccggtacggtaccggtaccccgtacgtaccgtacgtacgtacgtcgacgcggtcggtcggtacggacgtacgtacttactactctacacctactacgacgacgacgccgtacgacgacgtacgtacgtagtagtagtagtagttagtttagtttagttacgtactaaacttaattaattaattaacgttacgttacgttacggttacggttacggtaacggtaaacggtaacggtaacggtacgtaagtaacgtaacgtaacgtaacgtacgtacgtacgtacgtacgtacg

SEQ ID NO: 430235 - DNA, 634 bp, Homo sapiens
  misc_feature: GZ8MTXP02HO5MH.19.71.G05.1.454.CMB.2.raw
  modified_base (238)..(238): a, c, t, g, unknown or other
  modified_base (248)..(248): a, c, t, g, unknown or other
  modified_base (250)..(250): a, c, t, g, unknown or other
  modified_base (252)..(252): a, c, t, g, unknown or other
  modified_base (262)..(262): a, c, t, g, unknown or other
  modified_base (306)..(306): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacgatcaactgcaagtccagccacaatctttanacagtccaanananaaactactanctgacagacagagacagacacgcctcgagctgctctatttacgnggactacgtaccgtaacccggggtacgtcccggggtccccctacgaccgtacttacgaggtcggcgtacgggccggggttacgtaggggacctaagttactttaccacctcctaccacccgatacacgacgacgtaccgtcgacgacgtacgtagaagtagtaggtaggtagttagtttatttattacgttaactaaactaaattaatttaatttaacttacgttacggttacggtacggttaccggtaccggtaaacgggtaacggtaacggtacggtaagtaacgtaacgtaacgaacgtaacgtacggtacggtacgtacgtacg

SEQ ID NO: 430236 - DNA, 517 bp, Homo sapiens
  misc_feature: GZ8MTXP02I50IV.19.71.G05.1.454.CMB.2.raw
  modified_base (412)..(412): a, c, t, g, unknown or other
  modified_base (431)..(431): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatccgagaggtctagagtggctggggaaggacatactttcatgtccaacacgtaggaaatacaaaagttatgacacctattctgttgagagtcgactgaacaatcaaacgtgaanacatcgaagaaccagttcnccctgcaggctgacctctgtcacgtcccgaaggacgacgggtcgtaataagtacgtaggtacggaacgacggtaccccaagtaacg

SEQ ID NO: 430237 - DNA, 623 bp, Homo sapiens
  misc_feature: GZ8MTXP02GPWR1.19.71.G05.1.454.CMB.2.raw
  modified_base (236)..(236): a, c, t, g, unknown or other
  modified_base (245)..(245): a, c, t, g, unknown or other
  modified_base (254)..(254): a, c, t, g, unknown or other
  modified_base (258)..(258): a, c, t, g, unknown or other
  modified_base (275)..(275): a, c, t, g, unknown or other
  modified_base (277)..(277): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggcctacgactacgacgtcgactaaggccagccanaatctttanacatacaanatanaactactatctgtacananagagacagacacgctcgtacgctcgctctacttacgtcggtcgtacgtaccgtaccggtacggtaccggtaccccgtacgtaccgtactacgtacgtcgcgcggcgggtcggtacggacgacgtacgttactactactacaccactacacgacgacgccgtcgacgacgacgtacgtaagtagtagtaggtacgttagtttattagttacgtactaaactaattaattaattacttacgttacggttacggttacggttacggtaacggtaaacggtaacggtaacggtacggtaacgtaacgtaacgtaacgtaacgtaacggtacggtacggtacgtacgtacg

SEQ ID NO: 430238 - DNA, 521 bp, Homo sapiens
  misc_feature: GZ8MTXP02GMO1R.19.71.G05.1.454.CMB.2.raw
  modified_base (229)..(229): a, c, t, g, unknown or other
  modified_base (238)..(238): a, c, t, g, unknown or other
  modified_base (264)..(264): a, c, t, g, unknown or other
  modified_base (339)..(339): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttcaacaatgaaaactacttancttggtaccagcagagaccaggacagcctctaggctgctcattactggcatctaccgggaatccccggggtcccngaccgattcagttggcagcgggtctggggacagactttcactctcacatcagcagcctgcaggctagaagatgtggcagtttatattgtacaataatattattataacttgtaggtacgttcggaccaaagggacccaaaggttaggaataagtacgaagacgtaaacgtagtggacttcgg

SEQ ID NO: 430239 - DNA, 523 bp, Homo sapiens
  misc_feature: GZ8MTXP02GWLA6.19.71.G05.1.454.CMB.2.raw
  modified_base (237)..(237): a, c, t, g, unknown or other
  modified_base (361)..(361): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactacttagcttggtaccagcagagaccaggacagcctcctaggctgctcatttactggcatcctacccggggatccggggtccccctgaccgtattcagtggcnggcgggtctggggacagtatttcactctcaccatcagcagccctgcaggctagaagatgtggctagtttattattgtacaataattattattatacttcgtggtacgttcggaccgtaaagggaaccaggtcgtatagtcgagaacgactgtaggcctgacc

SEQ ID NO: 430240 - DNA, 600 bp, Homo sapiens
  misc_feature: GZ8MTXP02I5KRT.19.71.G05.1.454.CMB.2.raw
  modified_base (235)..(235): a, c, t, g, unknown or other
  modified_base (238)..(238): a, c, t, g, unknown or other
  modified_base (246)..(246): a, c, t, g, unknown or other
  modified_base (250)..(250): a, c, t, g, unknown or other
  modified_base (256)..(256): a, c, t, g, unknown or other
  modified_base (306)..(306): a, c, t, g, unknown or other
  modified_base (346)..(346): a, c, t, g, unknown or other
  modified_base (358)..(358): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccacaatctttanacngttccaanatanaaactntagctgacagcagacgaccagacacgtcctcgagctgctactatttacgnggactacgtccgtaccggtagtccgggtcccctgaccgtntcgagtcggcgngcggtcgtcggacgagtacttctactctactacctactacacgacgacgccgtcgacgacgacgtagagtagtaggtcggtacgttagtttatttagttacgtactaaactaaattaattaatttaacgttacgttacggttacggtacggttaccggtaaccggtaaacgggtaacggtaacggtacggtaacgtacgtaacgtaacggtaacgtaacgtacggtacggtacgtacgtacg

SEQ ID NO: 430241 - DNA, 568 bp, Homo sapiens
  misc_feature: GZ8MTXP02FLGFA.19.71.G05.1.454.CMB.2.raw
  modified_base (240)..(240): a, c, t, g, unknown or other
  modified_base (318)..(318): a, c, t, g, unknown or other
  modified_base (357)..(357): a, c, t, g, unknown or other
  modified_base (370)..(370): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgacaagtccagccacaatctttanacagttccaaacaatgaaaactacttagcttggtaccagcagacgaccaggacagcctcctaggctgctcatttacgnggctacgtccgtaccggacgtccgggtcccctgaccgtntcgagtcggacgngggcgggtctagggactagtactttccactcctaccaccatcgacgcgacgcctagcgaggacgtagaagtgtggtgtacttagtttattagttacgtaactaaataattattaattattacgttcggtacggtacggtacggaacgtaacgggacgtaggtagtactagaacgaacgacgtacgtgtacggctcgac

SEQ ID NO: 430242 - DNA, 509 bp, Homo sapiens
  misc_feature: GZ8MTXP02IXNYH.19.71.G05.1.454.CMB.2.raw
  modified_base (328)..(328): a, c, t, g, unknown or other
  modified_base (471)..(471): a, c, t, g, unknown or other
  modified_base (497)..(497): a, c, t, g, unknown or other
  modified_base (504)..(509): a, c, t, g, unknown or other
tcagtactctcgtgcacgaccggtgctcgatttagtgtcgtcgcaagagagagggggcacttctccctctaacactctcccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttactgggcatctacccgggatccggggtccctgaccgattcagtggcagcgggtctgggacagatttcactctcaccatcagcagcctgcaggctgaagntgtggcctagtttattattgtacaactaattattattatacttcgtggacgttcggaccaaaggggaccaaaggtggaatatcgagacgaactgtaggctgacaccatctgtctttcacttccttcccgctatctgacacganagtctggagcgggctgggcaagggcncagtagnnnnnn

SEQ ID NO: 430243 - DNA, 646 bp, Homo sapiens
  misc_feature: GZ8MTXP02F8I05.19.71.G05.1.454.CMB.2.raw
  modified_base (242)..(242): a, c, t, g, unknown or other
  modified_base (253)..(253): a, c, t, g, unknown or other
  modified_base (258)..(258): a, c, t, g, unknown or other
  modified_base (268)..(268): a, c, t, g, unknown or other
  modified_base (314)..(314): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacgactgacaagtcagccacaattctttanactactacaanaatanaaactactanctacgacagcagacgacagacacgcctcgagctgctactattacgnggactacgtaccgtaaccggggtacgtccccgggtacccctacgaccgtagttacgaggtcggacgtcggggtccgggtacggtacgggactagttactttaccaccttcctacctacctactacgacgacgacgccgtcgacgacggacgtagaagtagtaggtacggtacgttagtttagtttagttacgtaactaaacttaaattaatttaattaacgttacgttacggttacggttacggttacggtaaccggtaaacggtaacggtaacggtacggtaacgtaacgtaacgtaacgtaacgtacgtacggtacggtacgtacgtacg

SEQ ID NO: 430244 - DNA, 582 bp, Homo sapiens
  misc_feature: GZ8MTXP02GK24L.19.71.G05.1.454.CMB.2.raw
  modified_base (239)..(239): a, c, t, g, unknown or other
  modified_base (319)..(319): a, c, t, g, unknown or other
  modified_base (420)..(420): a, c, t, g, unknown or other
  modified_base (443)..(443): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttanacagttccaaacaatagaaaactacttagcttaggtaccagcagagaccaggacagcctcctaggctgctctatttacgngggcatccgtaaccccggggaatcccggggtcccccctggacccgattccaggtcggcagggcgggtcgtaggggactagatttccactctcacccatcancacgcctgccagggctagaaagngtgtggactagttttattagttagtacaaactaattaattattacttacgttcggtacggtaccgtttacggaccgtaaaggggtacctaaagggtcggtaattagtaacgaagaacgtaacgtggtaggcgtacgacc

SEQ ID NO: 430245 - DNA, 533 bp, Homo sapiens
  misc_feature: GZ8MTXP02GVRWD.19.71.G05.1.454.CMB.2.raw
  modified_base (289)..(289): a, c, t, g, unknown or other
  modified_base (322)..(322): a, c, t, g, unknown or other
  modified_base (341)..(341): a, c, t, g, unknown or other
  modified_base (404)..(404): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcacgtgggtcaggcagtccccatcgagaggtctagngtggctagggaaggacatatttcatgtaccaanacgtggaatacaaatttangacaccatctgtgagagtcgatgacaaatcaaacgtagacacatacgaaagaaccagttaccncctagacagctacgacctcgtcgtacgaccgtcccgaggacgacgggtatatacttacgtagtacggaagaccggaccccaagtacgacactacgaaccctaccgtcgtcctcgtggtcgtacttaacg

SEQ ID NO: 430246 - DNA, 526 bp, Homo sapiens
  misc_feature: GZ8MTXP02I833Z.19.71.G05.1.454.CMB.2.raw
  modified_base (237)..(237): a, c, t, g, unknown or other
  modified_base (312)..(312): a, c, t, g, unknown or other
  modified_base (360)..(360): a, c, t, g, unknown or other
  modified_base (418)..(418): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactactagcttggtaccagcagagaccaggacagcctcctaggctgctcatttacnggcatccgtacccgggaatccggggtcccctgaccgtattcagtggcnggcgggtctgggacagactttcactctcaccatcagcacgcctagcaggctagaaagntgtggactagtttattatgtactaaactaatattattatacttcgtagacgttcggacaagggaaccaggtacggtatagtaacgaagacgaacgtgtcggactcgac

SEQ ID NO: 430247 - DNA, 593 bp, Homo sapiens
  misc_feature: GZ8MTXP02JLF3V.19.71.G05.1.454.CMB.2.raw
  modified_base (235)..(235): a, c, t, g, unknown or other
  modified_base (244)..(244): a, c, t, g, unknown or other
  modified_base (248)..(248): a, c, t, g, unknown or other
  modified_base (254)..(254): a, c, t, g, unknown or other
  modified_base (257)..(257): a, c, t, g, unknown or other
  modified_base (301)..(301): a, c, t, g, unknown or other
  modified_base (369)..(369): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgcaagtccagccacaatctttanacatacaanatanaaactntanctagacagcagacgacagacagcctcgtagctgctctattacgnggctacgtccgtaacccgggacgtcccggggtcctacgaccgtattcgaggtcggcgagggcgggtcngggactagtacttacactctaccacactcgacgcacgcctagacgacggtctagaagtagtggtggtacttagtttattagttacgtactaaactaattatttattaacgttacgttacggtacggttaccggttacggaccgtaaacggggtaaacgtaaacgggtacgtaacgtaacgtacgaacggtaacggtaacgtcggtacgtacgtacgacctaacg

SEQ ID NO: 430248 - DNA, 548 bp, Homo sapiens
  misc_feature: GZ8MTXP02FP57T.19.71.G05.1.454.CMB.2.raw
  modified_base (351)..(351): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcacgtccccatcgagaggtctagagtggctggggaaggacattatttcattcgtaccaacgtacgtaggaaactaacaaattancgacaccatctgttagaagagtcgactgaacatacaacgtagaacacatacgaagaacctagttcctaccgtgacgacgctcgaccttcgtcgtacgacccgtccggaggaccgtacggtagtacgtacgttacgtggtaggaacgaccgaccccagtacgacatcgcctaccgtctcgtcgtaggtcgtacttacg

SEQ ID NO: 430249 - DNA, 631 bp, Homo sapiens
  misc_feature: GZ8MTXP02JQE5R.19.71.G05.1.454.CMB.2.raw
  modified_base (231)..(231): a, c, t, g, unknown or other
  modified_base (240)..(240): a, c, t, g, unknown or other
  modified_base (248)..(248): a, c, t, g, unknown or other
  modified_base (252)..(252): a, c, t, g, unknown or other
  modified_base (258)..(258): a, c, t, g, unknown or other
  modified_base (261)..(261): a, c, t, g, unknown or other
  modified_base (306)..(306): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgaccccagtctccagactccctggctgtgtctctgggcgagcgggccacgatacgaactgacaagtccagccanaatctttanacatcaanatanaaactntanctgacagcagagacagacacgcctcgtagctgctactatttacgnggctacgtaccgtaaccgggacgtcccgggtcccctacgaccgtattcgaggtcggacgcgggtcgggtacgtacgggactagttactttccactcctaccaacctactacgacgaccgacgtcccgtgacgacggtacgtaggaaagtagttggtacggtacgtttaaggttttacttagttacgtaactaaacttaatttaatttaagtttacgttacgttacggttaacggtacggtttaccggaaccggtaaacgggtaaccgtaagggtacgtaacgtacgtaacgaacgtaacgtacgtacggtacgtacgtacgaccg

SEQ ID NO: 430250 - DNA, 607 bp, Homo sapiens
  misc_feature: GZ8MTXP02JTY65.19.71.G05.1.454.CMB.2.raw
  modified_base (238)..(238): a, c, t, g, unknown or other
  modified_base (249)..(249): a, c, t, g, unknown or other
  modified_base (314)..(314): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgtttctctggatctctggtgcccacggggacatcgtgatgacccagtctccagactccctggctgtgtctctgggcagcgggccaccatcaactgcaagtccagccacaatcttttaanacattaccaanaatagaaactactagcttagaccagcagacgaccaggacagcctcgtaggctgctctatttacgngggactatccgtaaccgggacgtcccggggtcctcgaccgtatcgaggtcggcgagggcgggtcagggactagtactttacactctaccacctatcagcagtcctcgcgacgacgtagaagtagtggtcggtacgtagtttagttagttagttacgtaaactaaattaattaattaacttacgttacgttacggtacggttacggtaccggtaaacgggtaaccggtaaacggtacggtacgtaacgtacgtaacgtaacgtaacgtacggtacggtacgtacgtacgtaccg

SEQ ID NO: 430251 - DNA, 586 bp, Homo sapiens
  misc_feature: GZ8MTXP02I9M7T.19.71.G05.1.454.CMB.2.raw
  modified_base (386)..(386): a, c, t, g, unknown or other
  modified_base (528)..(528): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcaccgtcaggtccaggactggtgaagccctcgcagaccctctcgctcacctgtgccatcgtccggggacagagtcgctagcgacagtgttgcttggcacgtggtcaggcacgtccccagtccgagaggtctaggagtggcgtaggggaaggactatatttcagttcgtccaaacgacggtaggaaactaactaaaagtttanagaccacctatcgtagttgagagtcactagaactaatacgaaacgtagaacacaagtacgaaacgtaacccagttcctaccctgacagtcctacgaacccttctacggtcgaacccgtccggaacggaccgtaacggggttnttaacttaacggttaccttagggtacgggaacgtaaccgggaccccctaagtaaccgg

SEQ ID NO: 430252 - DNA, 533 bp, Homo sapiens
  misc_feature: GZ8MTXP02GOFKM.19.71.G05.1.454.CMB.2.raw
  modified_base (323)..(323): a, c, t, g, unknown or other
  modified_base (349)..(349): a, c, t, g, unknown or other
  modified_base (528)..(533): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccgatacgaactgacaagtccagccacaatcttttatacagttccaacaatgaaaactacttagcttggtaccagcagagaccaggacagcctcctaggctgctcatttactgggcatctacccgggaatcccggggtcctgacccgattcagtggcagcgggtcgtggacagatttcactctcaccatcagcagcctncagctgagatgtgcagttattatgtnacaatattattatattcgtgtacgtttacgacaagggaccgaaggtagggatatagagacgtaaacgtagttagggccgtcgacactactctcgtacttactactccttcccgtacctactctacgacgacgacgtacgtacgtagacggcggacgtcggacgacgacgaacgagtagnnnnnn

SEQ ID NO: 430253 - DNA, 539 bp, Homo sapiens
  misc_feature: GZ8MTXP02IPKNY.19.71.G05.1.454.CMB.2.raw
  modified_base (344)..(344): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccatcgagaggtctagagtggcgtgggaagcatatttcatgtccaanacgtaggaatacaaattatgcaccatctgttgagagtcgactgaacaatacgaaacgtagacaacatacgaaagaaaccctacgttacctccctagacagactgaccctcgtgtacgacgtacccggaggaccgtaccgggtgttaagtaacgttacgtaggttacggaacggaccggtaccccctaagtaaccg

SEQ ID NO: 430254 - DNA, 699 bp, Homo sapiens
  misc_feature: GZ8MTXP02GTI15.19.71.G05.1.454.CMB.2.raw
  modified_base (245)..(245): a, c, t, g, unknown or other
  modified_base (327)..(327): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccacgatacgaactgacaagtccagccactaattcttttaanactacgttaccaataatagaaactactagtcttagaccagacagacgaccagacacgcctcgtagctgctactactttacgnggactacgtaccgtaccgggtacgtcccggggtacccctacggtaccgtattcgaggtcggacgtcgggtcgggtacgtagggactagttactttaccacttcctaccaacctactaccgacgacgacgtaccgtacgacgtacggtacgtaacgtaaaggtacggttacggttacggttacgttaagttttaagtttaacgttaacgttaaacgttaaacttaaactttaaactttaatttaaacgtttaacgtttacggttacgggttaacggttaccgggtaaccggtaaacgggtaaacggtaaacggtaacggtaacgtaacgtaacgtaacgtaacgtaacggtacggtacggtacgtacgtaccg

SEQ ID NO: 430255 - DNA, 569 bp, Homo sapiens
  misc_feature: GZ8MTXP02IY95T.19.71.G05.1.454.CMB.2.raw
  modified_base (236)..(236): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttaggtaccagcagagaccaggacagcctcctaggctgctctatttactgggctatccgtacccggggaactccggggtccctcgaccgattcgagtggcagcggggtctgggacagatttcactctcaccatcagcagccctgacaggctagaagagtgtggacttagtttattagttagtactaaataattatttaattattacgttacgtaggttaccgttcggaccgtaaagggaacccgtaaagggtacggtaactaagtaccgaaggtaacgaaagttcgtggaccttcggactaaccg

SEQ ID NO: 430256 - DNA, 604 bp, Homo sapiens
  misc_feature: GZ8MTXP02JNJU9.19.71.G05.1.454.CMB.2.raw
  modified_base (238)..(238): a, c, t, g, unknown or other
  modified_base (247)..(247): a, c, t, g, unknown or other
  modified_base (251)..(251): a, c, t, g, unknown or other
  modified_base (272)..(272): a, c, t, g, unknown or other
  modified_base (306)..(306): a, c, t, g, unknown or other
  modified_base (361)..(361): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatctttanacatacaanatanaaactctagctgacagcaganacagacacgcctacgaggctgctactatttacgnggactacgtccgtaccgggagtccgggtacccctgaccgtattcgaggtcggacngggtcgggtcgtacggggactagtactttcactccacaccatcagcacgcctcgcgacgacgtagaagagtaggtggtacgttagtttatttattacgtaactaaactaaattaatttaatttaacgttaacgttacggttacggttacggttaccggtaaccggtaaacgggtaaacggtaacgggtacggtaacgtaacgtaacgtaacgaacgtaacgtacggtacggtacgtacgtacg

SEQ ID NO: 430257 - DNA, 618 bp, Homo sapiens
  misc_feature: GZ8MTXP02JX39T.19.71.G05.1.454.CMB.2.raw
  modified_base (238)..(238): a, c, t, g, unknown or other
  modified_base (304)..(304): a, c, t, g, unknown or other
  modified_base (311)..(311): a, c, t, g, unknown or other
  modified_base (339)..(339): a, c, t, g, unknown or other
  modified_base (355)..(355): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggaccagcagagaccaggacagcctctaggctgctnatttacnggcatccgaccgggatccggggtccccngaccgattcagtggcnggcgggtctgggacagtatttcactctcaccatcagcagcctgcgaggctaggaaagtgtggtacggtcttaaggttttattagtttcgtacctaaaactaaatttatttaatttaacttacgttacggttacgggtaaccggtttccgggaaacccggtaaaacgggggtaaccccgtaaaagggggttacggtaaactttaagtaaccggtaaacggaaaccggtaaaaccgttggtacggggtaaccttcggtaaccccg

SEQ ID NO: 430258 - DNA, 530 bp, Homo sapiens
  misc_feature: GZ8MTXP02FRANW.19.71.G05.1.454.CMB.2.raw
  modified_base (413)..(413): a, c, t, g, unknown or other
  modified_base (461)..(461): a, c, t, g, unknown or other
  modified_base (492)..(492): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggctggggaagactatatttcattgtccaacagtagaaataacaaaattatagacacatctgttgagtagtacgactgaacaaatacgaaacgtanaacaacaatacgaaagaaccacgttcctaccctgcagctacgaccctntgtacgacctacccggaggacgtaacgggtntaataagttactgtacggaagaccggccccaagtaacg

SEQ ID NO: 430259 - DNA, 568 bp, Homo sapiens
  misc_feature: GZ8MTXP02IZQ5L.19.71.G05.1.454.CMB.2.raw
  modified_base (317)..(317): a, c, t, g, unknown or other
  modified_base (374)..(374): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgcccatcgtccggggacagagtcgctagcgacagtgtgcttggcacgtgggtcaggcacgtccccatcgagaggtctagngtggcgtaggggaagacattatttcattgtccaacgtacggtgaaattacaaatttntcgacacctatctgttgagagtcgactagaacatacaaacgtagacacatacgaacgtaaccacgttcctacccgtgactagtccgtacgtacccttcgtacggtacgaccgttaccccggaagggtaccgtacggggttattaagttaacgtttacgtaggtacgggaacgaccggacccccgtaagtaacgg

SEQ ID NO: 430260 - DNA, 628 bp, Homo sapiens
  misc_feature: GZ8MTXP02GVGNV.19.71.G05.1.454.CMB.2.raw
  modified_base (236)..(236): a, c, t, g, unknown or other
  modified_base (244)..(244): a, c, t, g, unknown or other
  modified_base (248)..(248): a, c, t, g, unknown or other
  modified_base (254)..(254): a, c, t, g, unknown or other
  modified_base (301)..(301): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacatcaactgcaagtccagccacaatctttanacatcaanatanaaactntagcttgacagcagagacagacagcctcgagctgctactatttacgnggctacgtaccgtacccggggtaacgttccccggggtccccctacgaccgtattcgaggtcggcgtcggggtcgggtcgtaggggactagttactttccaccttcctaccaccatcgacgcacgcctgacgaggctagaaagtgtggtagtacgttagttttattagttacgtaactaaattaaatttaatttaatttaacgttacgtttacggttacgggtaccggtttaccgggaaccgtaaacggggtaaccgtaaacggggttacggtaacgttaactaaccgaaacggtaaccgtaaacgttggtacggtacgtacgtaccg

SEQ ID NO: 430261 - DNA, 561 bp, Homo sapiens
  misc_feature: GZ8MTXP02GDCFV.19.71.G05.1.454.CMB.2.raw
  modified_base (240)..(240): a, c, t, g, unknown or other
  modified_base (320)..(320): a, c, t, g, unknown or other
  modified_base (360)..(360): a, c, t, g, unknown or other
  modified_base (380)..(380): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggaccaccatcaactgcaagtccagccacaattcttttanacagttccaaacaatagaaaactacttagcttaggtaccagcaagagaccaggacagcctcctaggctgctctatttacngggactatccgtaacccggggaagttcccggggtcccccngacccgtatcgaggtggacnggccgggtctggggacagtatttcactctcaccatcagcagccctgcgaggctaggaaagtatggtagactaagtttattatacgtacaaataattattattaattacgttcgtacggtacgttcggacctaaacgggacaaggttagatataacgagaaccgtaactgtacggctagacc

SEQ ID NO: 430262 - DNA, 565 bp, Homo sapiens
  misc_feature: GZ8MTXP02FNKUC.19.71.G05.1.454.CMB.2.raw
  modified_base (227)..(227): a, c, t, g, unknown or other
  modified_base (237)..(237): a, c, t, g, unknown or other
  modified_base (309)..(309): a, c, t, g, unknown or other
  modified_base (337)..(337): a, c, t, g, unknown or other
  modified_base (396)..(396): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgacaagtccagccanaattctttanacagttccaacaatagaaaactactagctggtaccagcagagaccaggacagcctcctagctgctcattacngggcatccgtaccggatcccggggtccncgaccatcagtggcaggtcgggtctgggacagtactttcactctacacatcagcagccngacgagctagaagtagtgtagtacttagtttattagttagtaactaaataattaatttaattacttacgttcggtacggtaccggttacggaaccggtaaacgggtaccgtaaaggtacgtaactacgtacgaacggtaacgtaacgtcggtacgactacgactaaccg

SEQ ID NO: 430263 - DNA, 549 bp, Homo sapiens
  misc_feature: GZ8MTXP02IEHUB.19.71.G05.1.454.CMB.2.raw
  modified_base (316)..(316): a, c, t, g, unknown or other
  modified_base (383)..(383): a, c, t, g, unknown or other
  modified_base (473)..(473): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcacgaccctctcgctcacctgtcgccatcgtccggggacagagtcgctagcgacagtgttgcttggctacgtgggtcaggcacgtccccatcgagagtctagngtggctaggggaagactatagtttcattcgtaccaaacgtacggtaggtaaaattaccaaaatttancgactaaccaattcgtgttaggaagagttacgactgaacatacaaacgtagacacgaatacgaagaccagttcacctgcagctcgacctntcgtacgacctaccggagtaccgacgggttataattaacgttacgtaggtacggaaacgtccggaccctagtaacg

SEQ ID NO: 430264 - DNA, 612 bp, Homo sapiens
  misc_feature: GZ8MTXP02F3073.19.71.G05.1.454.CMB.2.raw
  modified_base (229)..(229): a, c, t, g, unknown or other
  modified_base (239)..(239): a, c, t, g, unknown or other
  modified_base (249)..(249): a, c, t, g, unknown or other
  modified_base (253)..(253): a, c, t, g, unknown or other
  modified_base (308)..(308): a, c, t, g, unknown or other
  modified_base (365)..(365): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccanaattctttanactatacaanatanaaactatagctagacagacagacacagacacgcctcaggctgctctaatttacgnggctacgtaccgaaccgggtacgtcccgggtcccctagaccgtattcgaggtgacgnggtcgggtctagggactagtactttcactctaccgacctatacgacgacgacgtaccgtacgacgacgacgtagaagtagtaggtacggtacgttagtttagttagttacgtactaaactaaattaattaattaacttaacgttacgttacggttacggttacggtaaccggtaaacggtaaacgtaacggtaacggtaagtaacgtaacgtaacgtaacgtaacgtacggtacgtacgtacgtacg

SEQ ID NO: 430265 - DNA, 617 bp, Homo sapiens
  misc_feature: GZ8MTXP02J0O07.19.71.G05.1.454.CMB.2.raw
  modified_base (234)..(234): a, c, t, g, unknown or other
  modified_base (243)..(243): a, c, t, g, unknown or other
  modified_base (247)..(247): a, c, t, g, unknown or other
  modified_base (256)..(256): a, c, t, g, unknown or other
  modified_base (301)..(301): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacatacaanatanaaactctanctagacagcagacgacagacacgcctcgagctgctactattacgnggctacgtaccgtaacccgggtagtccccggggtcctacgaccgtattcgaggtcggacgacgggtcggggtcgtaggggactagttactttcgaccttcctacccacctactacacgccacgccgtgacgaggtcgtagaagtagtggtggacttagtttattagttagtaactaaattaattaatttaattaacttacgttacggtacggttaaccggttaccggaaaccggtaaacgggtaaaccgtaagggtacgtaactacgtaacgtaacggtaaccgtaacgttcggtacggtccgtacgacctaaccg

SEQ ID NO: 430266 - DNA, 513 bp, Homo sapiens
  misc_feature: GZ8MTXP02GKHW4.19.71.G05.1.454.CMB.2.raw
  modified_base (235)..(235): a, c, t, g, unknown or other
  modified_base (246)..(246): a, c, t, g, unknown or other
  modified_base (308)..(308): a, c, t, g, unknown or other
  modified_base (404)..(404): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaanaatagaaaactactagcttggtaccagcagagaccagacagcctctaggctgctcatttacngggcatccgaccgggatcccggggtcctgaccgattcgagtgcagcgggtctgggacagtattcactctcacatcagcagcctgcaggctagaagntgtgacttagtttatattgacaatattattattatacttcgtaggtacgttcggacgaaacgggtaccaagggttcgatacgtacaagacgtaactggtagctgacacg

SEQ ID NO: 430267 - DNA, 538 bp, Homo sapiens
  misc_feature: GZ8MTXP02I5LJD.19.71.G05.1.454.CMB.2.raw
  modified_base (234)..(234): a, c, t, g, unknown or other
  modified_base (300)..(300): a, c, t, g, unknown or other
  modified_base (351)..(351): a, c, t, g, unknown or other
  modified_base (358)..(358): a, c, t, g, unknown or other
  modified_base (403)..(403): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtcagccacaatctttanacagttccaacaatgaaaactactagcttggtaccagcagagaccaggacagcctctaggctgctnatttactggcatctaccgggaatccggggtcccctgaccgattcgagtgcngcggtcngggacagatttcactctcaccatcagcagcctgcaggctgaaagntagtggctagtttattattgtcaaactaattattattaataacttcgtaggtacgttcggaccaaaggggtacctaaaggggtacggtataacgttccgaaagtaacggtaaaactggtcggtacctggtaaccc

SEQ ID NO: 430268 - DNA, 607 bp, Homo sapiens
  misc_feature: GZ8MTXP02HME1Z.19.71.G05.1.454.CMB.2.raw
  modified_base (327)..(327): a, c, t, g, unknown or other
  modified_base (348)..(348): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagagtcaggagtggcgtagggaagacatatttcattcgtaccaanacggtaggaactaacaaattncgacaccgtatcgtagttagagacgttacgacgtagaactaaatcgaaacgtagaacactaagtacgaaacgacctacggtttcctcccgtgaccaacggtcctacggtaccttgtacggtaccgaccgtaccggaaggtaccgtacggggttataacgttagttacgtaggtacgggaacgtaccggaacccctaagtaccgacgtacttaccggaaccctaccgttaccgtcgttccgtggtacgttacttaacggg

SEQ ID NO: 430269 - DNA, 669 bp, Homo sapiens
  misc_feature: GZ8MTXP02GPZZB.19.71.G05.1.454.CMB.2.raw
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacctctcgcgtcacctacgtgtccactacgtccgggacggacaggtcgtcgtacgacgacgacgtggttgtcgttcggtcgaccttacgggttcggaggaccgacgtaccccgtaccgtacggtacggaggtaccggttaagaggtaggtccggtaggggaaaggggtaacctaataacgttttacttacgtacgttcccggaaacctaaacggtacgggtaaaagtaaacctaaattaaagtttcgaacgacctaaactcgttagttaggtaagagtaccggtacgagtaacgaaactacgtaaacgtacggtaacaactataacggtaaacggaaaacctacgtttaccgtaccccttcgactacggactcgtacccgtactcggtagacccgtaccgacggacgaaccggtgttactaagttacgtggtacgaggacgcccccgataacg

SEQ ID NO: 430270 - DNA, 613 bp, Homo sapiens
  misc_feature: GZ8MTXP02GZYI2.19.71.G05.1.454.CMB.2.raw
  modified_base (238)..(238): a, c, t, g, unknown or other
  modified_base (457)..(457): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctctaggctgctcatttacgtgggactacgtaccgtaccccggggaattccccggggtcccccctaggacccgtatttccgaggttcggcacgggtccggggtcgtggggaccaggtactttcacttctacacccatcagcagccctagcgaggctagaaagtntggtggtactaggttttatagttacgtacctaaataattaatttattacttaacgttcggttacggtacgtttcggacccgtaaaaggggtacccgaaaagggttacggaattaacgtaacgaaggtaaccgtaacttggtacggccttaggaccc

SEQ ID NO: 430271 - DNA, 535 bp, Homo sapiens
  misc_feature: GZ8MTXP02GIL68.19.71.G05.1.454.CMB.2.raw
  modified_base (235)..(235): a, c, t, g, unknown or other
  modified_base (248)..(248): a, c, t, g, unknown or other
  modified_base (314)..(314): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaatctttanacagttaccaaanaatagaaaactacttagcttggtaccagcagagaccaggacagcctcctaggctgctctatttacngggcattccgtacccggggaatcccggggtcctgacccgattcagtggcaggcgggtctgggacagtattcactctcaccatcagcagcctgcaggctagaagtatgtggtctaagtttattaattgtacctaaataattatttaattattaacgttcgtaggtacgttcgacgaaacggacaaaggtgaatctagaagacgaacgtgtacgctacgacac

SEQ ID NO: 430272 - DNA, 591 bp, Homo sapiens
  misc_feature: GZ8MTXP02IP96N.19.71.G05.1.454.CMB.2.raw
  modified_base (227)..(227): a, c, t, g, unknown or other
  modified_base (237)..(237): a, c, t, g, unknown or other
  modified_base (247)..(247): a, c, t, g, unknown or other
  modified_base (251)..(251): a, c, t, g, unknown or other
  modified_base (273)..(273): a, c, t, g, unknown or other
  modified_base (305)..(305): a, c, t, g, unknown or other
  modified_base (363)..(363): a, c, t, g, unknown or other
  modified_base (374)..(374): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacatcaactgcaagtcagccanaatctttaanactatacaanatanaaactatagcttgacagcaganaccagacacgcctcagctgctactatttacgnggacacgtaccgtacccggacgtcccggggtcccctacgacctattcgagtcggacgngggtcggtcgngggactagtattcactctcaccatacagcacgcctagacgaggacgtaggaaagtagtcggtaggtacgtttaagttttaattacgttacgtaactaaattaaatttaatttaaagtttactacgtttacggttacggtaccggttacggaaccgtaaacgggacgtaacgggtacgtaactaagaacgacgtaacgtaacgtggtacgtcacgacc

SEQ ID NO: 430273 - DNA, 578 bp, Homo sapiens
  misc_feature: GZ8MTXP02GRDQ0.19.71.G05.1.454.CMB.2.raw
  modified_base (236)..(236): a, c, t, g, unknown or other
  modified_base (245)..(245): a, c, t, g, unknown or other
  modified_base (249)..(249): a, c, t, g, unknown or other
  modified_base (258)..(258): a, c, t, g, unknown or other
  modified_base (265)..(265): a, c, t, g, unknown or other
  modified_base (270)..(270): a, c, t, g, unknown or other
  modified_base (301)..(301): a, c, t, g, unknown or other
  modified_base (365)..(365): a, c, t, g, unknown or other
  modified_base (403)..(403): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccaccatcaactgcaagtccagccacaatcttttanacatacaanatanaaactatanctgacancaganacagacagcctcaggctgctactatttacgnggctactaccgtaacccgggtaacgtcccggggtaccccctacgaccgtattcgaggtcggcgnggtcgggtcgtagggacagtattcactctacacatcancacgcctcgcgacgacgtagaagagtagtagtagtagtttattattagtactaactaaattaattaattaattacgttacgttacggtacggttacggtaccgtaaacggtaacggtaacggtacggtaagtaacgtaacgtaacgaacgtaacgtacgtacgtacgtacgtacg

SEQ ID NO: 430274 - DNA, 513 bp, Homo sapiens
  misc_feature: GZ8MTXP02I70XR.19.71.G05.1.454.CMB.2.raw
  modified_base (338)..(338): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtgaactacaaattangcaccatcgtgttgagtagtcgactgacaaatcaaacgtagaacacatacgaacgaacctagttcctaccctgacagctgacctctgtacgactcccgaggacgacgggtgtatattactagtggaagacggaccccagtacgacatacgccacctcgtctcgtggtcgacttag

SEQ ID NO: 430275 - DNA, 537 bp, Homo sapiens
  misc_feature: GZ8MTXP02JGTZT.19.71.G05.1.454.CMB.2.raw
  modified_base (235)..(235): a, c, t, g, unknown or other
  modified_base (312)..(312): a, c, t, g, unknown or other
  modified_base (358)..(358): a, c, t, g, unknown or other
  modified_base (365)..(365): a, c, t, g, unknown or other
  modified_base (375)..(375): a, c, t, g, unknown or other
  modified_base (389)..(389): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanacagttccaaacaatagaaaactactagcttggtaccagcagagaccaggacagcctcctaggctgctcatttacgnggcatccgtacccgggaatccggggcccctgaccgtatcgagtgcnggcggtntgggacagtntttcactctcaccntcagcagcctgcaggctagaagatggtgactagtttattattgtaactaaataattattattaactcgttacgtaggtacgtttcggaccgtaaagggaccgtaaggtacgataagtaacgaagaaccgacgtggtacggactagacc

SEQ ID NO: 430276 - DNA, 542 bp, Homo sapiens
  misc_feature: GZ8MTXP02HYFHV.19.71.G05.1.454.CMB.2.raw
  modified_base (240)..(240): a, c, t, g, unknown or other
  modified_base (315)..(315): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccacaattctttanacagttccaacaatgaaaactactagcttggaccagcagagaccaggacagcctcctaggctgctctatttacgnggcatccgacccggggaatcccccggggtccctgacccgtatttcgaggttggccgaggtccggggtctgggggaacctaggacttttccgactctacaccactcagcacgcctgcaggctagagatgtgctagtttatattgataacattattaatatacttcgtggtacgttcgacgaacggtaccgaaggtcgaataagtacgagacgaacgtcggtggactcg

SEQ ID NO: 430277 - DNA, 660 bp, Homo sapiens
  misc_feature: GZ8MTXP02HMDNB.19.71.G05.1.454.CMB.2.raw
  modified_base (233)..(233): a, c, t, g, unknown or other
  modified_base (242)..(242): a, c, t, g, unknown or other
  modified_base (252)..(252): a, c, t, g, unknown or other
  modified_base (256)..(256): a, c, t, g, unknown or other
  modified_base (311)..(311): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacgaactgacaagtccagccanaatctttanacataccaanatanaaactactagctagacagcagagacagacacgcctcgagctgctactatttacgnggactacgtaccgtaacccggggacgttccccggggtaccccctacggtaaccgtacttacgaggttcggacgtacggggtccgggttacgtacggggaacctagttactttaccgacctcctaccacctactacgacgccgacgtccgtagacgaggtacgtaaggaaagtagtaggtacggttacttaagttttagttaattacgtaaactaaacttaaatttaactttaacgttaacgtttacgttacggttacggtaccggtttaccggaaaccgtaaacggggtaacgtaaacgggtacgtaactaacgaacgtaagtaacgtacgtaggtacgtacgtacgac

SEQ ID NO: 430278 - DNA, 581 bp, Homo sapiens
  misc_feature: GZ8MTXP02I6XFX.19.71.G05.1.454.CMB.2.raw
  modified_base (538)..(538): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggcacgtgggtcaggcacgtccccatcgagaggtctagagtgggctaggggaagacattattcagttcgtccaaacgacggtaggaaaacttaactaaaatttactacgaccaacccgtaattccgttaggttacggaagtacggttcggaactaggaaacaaactacaaacgttaagacaactaatacgaaagaaccctagttcctacccgtgacacgctacgacctctacgcgtacgtacccgaggacgtacgggtntaacgtaagttacgtagtacggacgaccggaccctaagtaacg

SEQ ID NO: 430279 - DNA, 711 bp, Homo sapiens
  misc_feature: GZ8MTXP02IHTMB.19.71.G05.1.454.CMB.2.raw
  modified_base (238)..(238): a, c, t, g, unknown or other
  modified_base (248)..(248): a, c, t, g, unknown or other
  modified_base (250)..(250): a, c, t, g, unknown or other
  modified_base (252)..(252): a, c, t, g, unknown or other
  modified_base (258)..(258): a, c, t, g, unknown or other
  modified_base (307)..(307): a, c, t, g, unknown or other
  modified_base (404)..(404): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctcctggctgtgtctcgtgggcgagcgggccacgatacgaactgacaagtcagcacatctttanactatacaanananaaactntagctgacagcagacgacagacacgcctacgagctgctactatttacgnggactacgtaccgtaccggtacgtcccgggtacccctacgaccgtattacgaggtcggacgacgggtcggttacgacgggtactacgttctttaccnccgttactacccgaacctagtcgaacgtccgtacgtcccgtaggaccgtacgggtactaagggaaagttacggttggttacggttaacgtttaaggtttttaacgttaacgtttacgtaaaccttaaaacgtttaaactttaacgttttaaacgtttaacgtttaaccggtttacggttaaccgggttaaccggtttaacccgggaaaccggtaaacggggtaaaccgtaacggggttaacgtaagttaaacgtaacggtaaacggttaaaccgtaacggttacggtacggtacctacggtaacccg

SEQ ID NO: 430280 - DNA, 628 bp, Homo sapiens
  misc_feature: GZ8MTXP02H1TIB.19.71.G05.1.454.CMB.2.raw
  modified_base (241)..(241): a, c, t, g, unknown or other
  modified_base (255)..(255): a, c, t, g, unknown or other
  modified_base (260)..(260): a, c, t, g, unknown or other
  modified_base (321)..(321): a, c, t, g, unknown or other
tcagtactctcgtgcacgaccggtgctcgatttagtgtcgtcgcaagagagaggggggaggtacaacaggcatgcaggggcagcaagatggtgttgcagacccaggtcttcatttctctgttgctctggatctctggtgcccacggggacatcgtgatgacccagtctccagacctcctggctgtgtctctgggcagccgggccaccatcaactgacaagtccagccacaattcttttaanactacttaccaaanaatanaaactacttagcttagacagacagacgacagacacgcctcgagctcgtctactatttacgnggactacgtaccggtaaccgggacgtccccccggggtacctacgtaccgtattcgacggtcggcgtacggggtcgggtacgtagggaactacgttactttccacctccacacctatacacgcacgccgtacgcgacgacgtagaagtagtggtgtacgttaagtttattagtacgtaactaaactaaatttatttaacgttaacttacgtttacggtacggttaccggtaccggtaaccggtaaacgggtaaccgtaaggtagtaagtaacgtacgaaacgtacgtaacgttcggtacgtacgtacg

SEQ ID NO: 430281 - DNA, 647 bp, Homo sapiens
  misc_feature: GZ8MTXP02HLLYA.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctgcacgaccctctcgctcacctgtgccatcgtccggggacagacgtcgctagcgacagtgtgcgttggcacgtgggtcaggcacgtccccagtcgagaggtctagagtggcgtagggaagactatactttcgatgtccaaacgtacggtagaaacttaacgaaatttatacgactaacctattcgttagttagaagtacgtaccgtactagaacaaacgtcgaaaacggttacgaaacctaacgtaacgttaaccggaaaacgtaaacccgtaacggtttaccctaccccgttagacccgtacggtacctacgtaacccttcgttaccggtacggtaccccgttaccgggaacgggtaaccgtaacgggggttacttaaagttaacgttacgttacgggtacgggtaaacgtacccgggaccccttaagtaaccgg

SEQ ID NO: 430282 - DNA, 577 bp, Homo sapiens
  misc_feature: GZ8MTXP02H0C79.19.71.G05.1.454.CMB.2.raw
  modified_base (240)..(240): a, c, t, g, unknown or other
  modified_base (286)..(286): a, c, t, g, unknown or other
  modified_base (308)..(308): a, c, t, g, unknown or other
  modified_base (317)..(317): a, c, t, g, unknown or other
  modified_base (379)..(379): a, c, t, g, unknown or other
  modified_base (418)..(418): a, c, t, g, unknown or other
  modified_base (443)..(443): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccacaattctttanacagttaccaaacaatagaaaactactagcttaggtaccagcaganaccagacagcctcaggctgctntatttacgnggactacgtccgtaaccccgggaagtcccggggtcccctaggacccgtattcgaggtcggcnggggccgggtctggggactagtactttcactctcacccntcagcagccctgcgagctagaaagntggtgacttagtttatagtcgtacaaacttaatatttattatacgtttcgtacggtacgtttacgggactaaacgggacctaagggtcgtaatacgtaacgaacgtaacgtacgttggtacgtacgttacgacc

SEQ ID NO: 430283 - DNA, 511 bp, Homo sapiens
  misc_feature: GZ8MTXP02IM4XN.19.71.G05.1.454.CMB.2.raw
  modified_base (427)..(427): a, c, t, g, unknown or other
  modified_base (473)..(473): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgtgcttggcacgtggtcaggcagtccccatcgagaggtctagagtggctgggaagcatatttcatgtccaacacgtaggaatacaaattatgacacatctgttagagtagtcgactagaacaatcaaacgtagaacacatacgaagaaccagttccnccctgcagctcgacctctgtcgacctacccggaggacgacgggttntaataagttacgtgtacggaacgaccggacccagtacg

SEQ ID NO: 430284 - DNA, 523 bp, Homo sapiens
  misc_feature: GZ8MTXP02JFJBP.19.71.G05.1.454.CMB.2.raw
  modified_base (321)..(321): a, c, t, g, unknown or other
  modified_base (341)..(341): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtcagagtggctggggaagacatatttcatgtaccaanacgtggaaactacaaattangcaccatctgttgagagtcgatagacaatacaaagtagacacatacgaaacgaacctagttcctaccccgtgaccagtctacgtacctctagtacgaccgtcccgaggacgtacgggtgtactattacgtgtaggaagaccgacccagtacgacatcgccactcgtctcgtgtacgtctaag

SEQ ID NO: 430285 - DNA, 629 bp, Homo sapiens
  misc_feature: GZ8MTXP02JDN0J.19.71.G05.1.454.CMB.2.raw
  modified_base (242)..(242): a, c, t, g, unknown or other
  modified_base (254)..(254): a, c, t, g, unknown or other
  modified_base (321)..(321): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccaacaattctttaanacagttccaaanaatagaaaactcttagcttggtaccagcagagaccaggacagccctcgtaggctgctctatttacgnggactacgtaccgtaacccgggtacgtcccccggggtacctacgaccgtattcgaggtcggcgtacgggcgggtacgtaggggactagtactttccaccttcctaccaacctagtacgaacgcacgcctacgacgacggtacgtaggaaagtagtggtacgtattaagtttattagttacgtaactaaacttaatttaatttaattaacttacgttacggttacggtaccggttacggaaccggtaaacgggaacgtaagggtacgtaacgtaacgtacgaacgtacgtaacgtcggtacggactacg

SEQ ID NO: 430286 - DNA, 510 bp, Homo sapiens
  misc_feature: GZ8MTXP02GARVN.19.71.G05.1.454.CMB.2.raw
  modified_base (353)..(353): a, c, t, g, unknown or other
  modified_base (357)..(357): a, c, t, g, unknown or other
  modified_base (370)..(370): a, c, t, g, unknown or other
  modified_base (442)..(442): a, c, t, g, unknown or other
  modified_base (505)..(510): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactggcatctacccgggaatccggggtccctgaccgattcagtggcagcgggtctgggacagatttcactctcaccatcagcagccctgcaggctgaagatggtggccagtttatattgtcaanaatnttatatacttcgngtacgttcggcaaaggggccaaggtgactatcagacaatgtggctgcaccatctgtcttcatccttaccccncatcagacgacgagtacgtacgtaggacggcgggtctacggacggacggacgaacgacgtagnnnnnn

SEQ ID NO: 430287 - DNA, 619 bp, Homo sapiens
  misc_feature: GZ8MTXP02J2WZH.19.71.G05.1.454.CMB.2.raw
  modified_base (241)..(241): a, c, t, g, unknown or other
  modified_base (301)..(301): a, c, t, g, unknown or other
  modified_base (313)..(313): a, c, t, g, unknown or other
  modified_base (361)..(361): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccacggggacatcgtgatgacccagtctccagactccctggctgtgtctctgggcgagccgggccaccgatcaactgacaagtccagccacaatctttanacagttccaacatagaaactctagcttggaccagcagagaccaggacagcctcctaggcngctcatttacgngcagtccgtaccggactccgggtccccagaccgtatcgaggtcggcgngggtcgggtacgtagggactagttactttaccacttcctaccgacctactacacgcctacgccgtcgacgacggacgtagaagtagtggtacggtacgttagtttagtttagttagttactaaactaaacttaatttaatttaacttaacgttacggttacggtaccggtaccggtaaccggtaaacggtaaacggtaacggtacggtaacgtaacgtaacgtaacgtaacgtacgtacggtacggtacgtacgtacg

SEQ ID NO: 430288 - DNA, 553 bp, Homo sapiens
  misc_feature: GZ8MTXP02JI7HI.19.71.G05.1.454.CMB.2.raw
  modified_base (242)..(242): a, c, t, g, unknown or other
  modified_base (320)..(320): a, c, t, g, unknown or other
  modified_base (372)..(372): a, c, t, g, unknown or other
  modified_base (389)..(389): a, c, t, g, unknown or other
  modified_base (439)..(439): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggccgggccaccatcaactgacaagtccagccacaattcttttanacagttaccaacaatagaaaactcttagcttggaccagcagagaccaggacagcctcctaggctagctacatttacgngggcactccgacccgggaatcccggggtcccctggaccgtattcaggtcgcnggcgggtctaggggacnggtatttcgaactcctcaccatcacgcacgcctagccgaggctagaaagntggtacggtatagtttatattgtacaaataatattattatacttcggtagtacgttcggaccaagggtacctaggtacgtatagtaacgacgtaacgactgtacggactgaacc

SEQ ID NO: 430289 - DNA, 622 bp, Homo sapiens
  misc_feature: GZ8MTXP02HF4CM.19.71.G05.1.454.CMB.2.raw
  modified_base (245)..(245): a, c, t, g, unknown or other
  modified_base (255)..(255): a, c, t, g, unknown or other
  modified_base (259)..(259): a, c, t, g, unknown or other
  modified_base (265)..(265): a, c, t, g, unknown or other
  modified_base (290)..(290): a, c, t, g, unknown or other
  modified_base (318)..(318): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccgatacgaactgacaagtccagccacaatctttanacataccaanatanaaactntagctagacagacagacgacagacncgcctacgtagctgctactagtttacgnggcacgtaccgtaaccgggtacgtcccgggtaccccctagaccgtatcgaggtcggacgtcgggtcgggtcgtagggactagttacttcacctcctaccacctatacgacgcgacgtcctacgacgacgacgtacgtaagtagtggtggtacgttagtttagttagttacgtactaactaaattaattaattaagttacgttacggttacggtacggttaccggtaccggtaaacggtaacggtaacggtacgtaacgtaacgtaacgtaacgtaacgtacgtacggtacggtacgtacgtacg

SEQ ID NO: 430290 - DNA, 631 bp, Homo sapiens
  misc_feature: GZ8MTXP02HRBBC.19.71.G05.1.454.CMB.2.raw
  modified_base (241)..(241): a, c, t, g, unknown or other
  modified_base (252)..(252): a, c, t, g, unknown or other
  modified_base (257)..(257): a, c, t, g, unknown or other
  modified_base (313)..(313): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcctggctgtgtctctggggcgagcgggccacgatacgaactgacaagtccagccacaatcttttaanacagtaccaanaatanaaactactagctagacagcagacgacagacacgcctcgagctgctactatttacgnggctacgtaccgtaccggtacgtcccggggtcccctacgaccgtagttcgaggtcggacgtcgggtcggggtacgtaggggactagtactttcctacctctaccaccactacacgacgacgtccgtacgacgacgtacgtacgaagtagtaggtaggtacgttagtttagtttagttacgtaactaaactaaattaatttaatttaacgttacgttacggttacggtacggttacggtacggtaaacggtaaacggtaacggtaacggtaagtaacgtaacgtaacgtaacgtaacgtacgtacggtacgtacgtacg

SEQ ID NO: 430291 - DNA, 596 bp, Homo sapiens
  misc_feature: GZ8MTXP02H4LNR.19.71.G05.1.454.CMB.2.raw
  modified_base (243)..(243): a, c, t, g, unknown or other
  modified_base (253)..(253): a, c, t, g, unknown or other
  modified_base (258)..(258): a, c, t, g, unknown or other
  modified_base (320)..(320): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcggccaccagtcaactgacaagtccagccacaatcttttaanacataccaanaatanaaactactagcttagaccagacagacgaccgagacacgtcctcgagctgctactatttacgnggactacgtaccgtaacccgggacgtcccggggtcccctacgaccgtatcgaggtcggcgcgggtcgggtcgtacgggactagtactttcactcctcactactacgacgcacgtcctgacgaggcgtagaagagtagtagtagttagttagttattacgtactaactaattaattattattacgttacgtacggtacgtacggtacggtaacggtaacggtacggtacgtaagtacgtaacgtacgtaacgtacgtacggtacggtacgtacgacg

SEQ ID NO: 430292 - DNA, 554 bp, Homo sapiens
  misc_feature: GZ8MTXP02IPTH9.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatcgtccggggacagagtcgctagcgacagtgttgcttggcacgtgggtcaggcagtccccatcgagaggtctagagtggcgtaggggaagacatatttcattcgtccaaagtacggtagaaataacaaattatgacaccatctagttgagagtcgactagaacaatacaaacgtaagacaacatacgaaagaaccctagttcctaccctagactacgtctacgtacccttcgtcgtacaccgtacccggacggtaccgtacgggttataagttaacttacgtaggtacggaacgaccggtacccctaagtaacg

SEQ ID NO: 430293 - DNA, 568 bp, Homo sapiens
  misc_feature: GZ8MTXP02FWYZV.19.71.G05.1.454.CMB.2.raw
  modified_base (241)..(241): a, c, t, g, unknown or other
  modified_base (318)..(318): a, c, t, g, unknown or other
  modified_base (430)..(430): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccaacaattctttanacagttaccaaacaatagaaaactcttagcttggaccagcagagaccaggacagcctcctaggctgctcatttacgngggctagtccgtacccggggaatccggggtccccctgacccgattcaggtgcaggcgggtctggggacagtactttcactctcacccatcagcagcctgcaggctagaaagntggtggactagttttattattgactaaataattattattaatacgttcggtacggtacgttcggaccgtaaaggggtacctaaagggttacgaattaagaacgaaggaaccgtaacgtggttacggcttacggaaccg

SEQ ID NO: 430294 - DNA, 507 bp, Homo sapiens
  misc_feature: GZ8MTXP02H03A9.19.71.G05.1.454.CMB.2.raw
  modified_base (237)..(237): a, c, t, g, unknown or other
  modified_base (311)..(311): a, c, t, g, unknown or other
  modified_base (355)..(355): a, c, t, g, unknown or other
  modified_base (410)..(410): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactactagcttggtaccagcagagaccaggacagcctctaggctgctcatttacnggcatctacccgggaatccggggtcccctgaccgatcagtggcngcgggtctggggacagtatttcactctcaccatcagcagcctgcaggctgaaagntgtggctagtttatattgtacaaataatattattatacttgtgtacgttcggacctaaagggaccaagggtgatagtcgagaacgactgtggctgac

SEQ ID NO: 430295 - DNA, 508 bp, Homo sapiens
  misc_feature: GZ8MTXP02GZL5O.19.71.G05.1.454.CMB.2.raw
  modified_base (339)..(339): a, c, t, g, unknown or other
  modified_base (356)..(356): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctggggaagacatattcatgtccanacgtggaaatacaaatngcaccatctgttgagagtcgactgaacaatacaagtagacaacatacgaagtaaccagttccaccctgacagcttagacctcgtacgtcgacctcccggaggactacggggtctattattaacgtgtaggaacgacggaccccagtacgaac

SEQ ID NO: 430296 - DNA, 640 bp, Homo sapiens
  misc_feature: GZ8MTXP02G4M64.19.71.G05.1.454.CMB.2.raw
  modified_base (483)..(483): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacaggacgtcgctagccgactagtgttgcgttggctacgtgggtcaggccacgtccccagtccggaggtaggtctaaggaggtcggacgtaggggaaacgactagttacttacgagttacgtacccaaacgtacggtaggtaaaacttaaccgtaaaagtttacgacgacctaaccgtaattcgtaggttacgagtacgtccgaactagaactaacgtacaaacggtaanaacacgtacgacgaaacgtaacctacgttaccacgtacgacgtcgtacgtacgtccttacgtacgtaccgtaccgtaccggaacggtaccgttaacggttataacgttaacgttaacggtacggtaacggaaccgtacccggtaacccgtaagtacg

SEQ ID NO: 430297 - DNA, 612 bp, Homo sapiens
  misc_feature: GZ8MTXP02IJXVB.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgcctcacctgtcgcccatcgtccggggacagagtcgctagcgacagtgtgcgttggcacgtgggtcaggcagtccccagtcgagaggtctagagtggcgtagggaagacattattcattcgtaccaactacgtaggaaataactaaattatacgactacattcgtagttgaagtagtaccgatagaactaaagtcaaacggtacgaaacacgtaacttacgaaacgtaaacccacgtttacctacccgtagtaccgaaggtcctacggtaacccttacgttacgtacgaccgttacccggaacggtacccgtaacggggttattaacgttaacgttaaccgttagggttacggaaaacggtacccggacccccgtaagtaaaccg

SEQ ID NO: 430298 - DNA, 578 bp, Homo sapiens
  misc_feature: GZ8MTXP02JHJ41.19.71.G05.1.454.CMB.2.raw
  modified_base (235)..(235): a, c, t, g, unknown or other
  modified_base (315)..(315): a, c, t, g, unknown or other
  modified_base (374)..(374): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttanacagttccaaacaatagaaaactacttagcttaggtaccagcagagaccaggacagcctcctaggctgctctatttacgnggcacgtccgtacccggggaactcccggggtccccctagacccgattccgaggtcggcnggggcgggtctggggaccagtactttcactctcacccatcagtcacgcctgcgaggctagaaagtagtggtggtacttagtttattattacgtactaaactaattattaatttactacgttcggtacggtacgttcggacccgtaaagggtacctaagggtacgtaatagtaacgaagtaaccgtacgtagtacgtctacgacc

SEQ ID NO: 430299 - DNA, 523 bp, Homo sapiens
  misc_feature: GZ8MTXP02H1XRH.19.71.G05.1.454.CMB.2.raw
  modified_base (222)..(222): a, c, t, g, unknown or other
  modified_base (233)..(233): a, c, t, g, unknown or other
  modified_base (515)..(515): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccaggggacatcgtgatgacccagtctccagactccctggctgtgtctctgggcagcgggccacatcaactgcaagtccagccanaattcttttanacagttccaaacaatagaaaactacttagcttggtaccagcagagaccaggacagcctcctaggctgctctatttactgggcatcgtaaccccgggaagtcccggggtccctgaccgtattcagtggcagcggggtctgggacagatttcacttctcacatcagcagcctgcagggctagaagatgtggactagtttattattagtactaaataattattattatacttacgtaggtacgttacggtacgaaacggtacaaggtgatatacaagacaactgngctgacac

SEQ ID NO: 430300 - DNA, 529 bp, Homo sapiens
  misc_feature: GZ8MTXP02JADNZ.19.71.G05.1.454.CMB.2.raw
  modified_base (524)..(529): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctagaagatgtggcctagtttattattgtacaaactaattatttattattacttcgtggtacgtttcggacccgtaaaggggaccaaagggtggaatatacgaagaccgtaatggtggctgaccacctagtcttgtcttcacttccttcccgcatctgactacgagacgttactggacggcggctgggacaaggcgcagtannnnnn

SEQ ID NO: 430301 - DNA, 586 bp, Homo sapiens
  misc_feature: GZ8MTXP02JPPFP.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccagtcgagagtctagagtggctgggaagacatatttcatcgtccaactacgtagaaatacgaaattatgacaacctatcctgttagagagttcgacttagaactaagtacgaaacgtagaacaacagtaacggaaagaacccgtaagttccctacccgttaggcaagtccgtacgaacccttcgtagtaccgaccgttaccccggaaagggtacccgtaacggggttagttaacttaagttaaccgtgggtaacggaaacggtacccggtacccccaaagttaaccgg

SEQ ID NO: 430302 - DNA, 610 bp, Homo sapiens
  misc_feature: GZ8MTXP02JO5AC.19.71.G05.1.454.CMB.2.raw
  modified_base (252)..(252): a, c, t, g, unknown or other
  modified_base (263)..(263): a, c, t, g, unknown or other
  modified_base (306)..(306): a, c, t, g, unknown or other
  modified_base (335)..(335): a, c, t, g, unknown or other
  modified_base (432)..(432): a, c, t, g, unknown or other
tcagtactctcgtgcacgaccggtgctcgatttagtgtcgtcgcaagagagaggggtgacggtacaacaggcaggcaggggtcagcaagatggtgttgcagacccaggtcttcatttctctgttgcttctggatctctggttgcccacggggacatcgttagatgacccagtctccagactccctggctgtgtcgtctgggcgagcgggccaccgatcgaactgactaagtccagccactaattcttttaanactactacaanaatagaaactatagtcttacgtaccagcagacgaccgaggacncgcctcgtaggctagtactataatttcgnggctacgtccgaccggagtcccccgggtccagaccgtactcgaggtcgcgcggtcggtcgaggactagtacttccactctaccacatacagcacgcngacgagtactagagtagtgtagtactttagtttattacgttacgtaactaaacgtaattaattacttaacgttacgttacggtacggttacggttaccggaacgtaaacgggtaaccgtaaggttagtaacttaacgtacgtaaacggtacggtacggttacggtacggtacgtaccg

SEQ ID NO: 430303 - DNA, 534 bp, Homo sapiens
  misc_feature: GZ8MTXP02FKXQT.19.71.G05.1.454.CMB.2.raw
  modified_base (234)..(234): a, c, t, g, unknown or other
  modified_base (245)..(245): a, c, t, g, unknown or other
  modified_base (306)..(306): a, c, t, g, unknown or other
  modified_base (409)..(409): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaanaatagaaaactactagctggtaccagcagagaccaggacagcctctaggctgctcattacngggcatcgtacccggatcccggggtcctcgaccgattcagtgcagcgggtctgggacagtatttcactctcaccatcagcagccctgcaggctagaagatggnggctagtttattagttagtacaataattattattatacttcgtaggtacgttcggaccgaaagggaccaaagggtacggtaactagtacgaaggtaacgtaacgtggtaggtctacgactaaccg

SEQ ID NO: 430304 - DNA, 526 bp, Homo sapiens
  misc_feature: GZ8MTXP02GWIAB.19.71.G05.1.454.CMB.2.raw
  modified_base (459)..(459): a, c, t, g, unknown or other
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagaccctctcgctcacctgtgccatctccggggacagagtcgctagcgacagtgttgcttggcacgtgggtcaggcagtccccatcgagaggtctagagtggctggggaagacatatttcattgtccaaacacggtaggaaatacaaattatgacaccatctgttagagtagtcgactagacaagtcaaacgtagacacatacgaaagaaccagttcctaccgtgactagctgaccttctggtnaccgttccgaaggtaccgacgggtattataagttacgtagtacggaacgacggtaccccaagtaacg

SEQ ID NO: 430305 - DNA, 627 bp, Homo sapiens
  misc_feature: GZ8MTXP02F28OB.19.71.G05.1.454.CMB.2.raw
  modified_base (328)..(328): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccagtcgagaggtctagagtggcgtgggaagacattatttcattgtccaaanacgtaggaactaacaaattatcgacaaccgattcgtgttagagtagtcgaactgaaacaagtacaaacgtagaacaacaatacgaaacgtaacacgttcctacctgacacgtctacgtaccttcgtacgtacgacccgtacccggacggaaccgtacgggttagtaacgttacgttaacgttacggtagggaaacggtacccgggaccccctaaagttaaccggtaaaccaacgttaccggaacccctaacccgttacccggtttaccctacgtttcggttacgtacgttttaaacggg

SEQ ID NO: 430306 - DNA, 572 bp, Homo sapiens
  misc_feature: GZ8MTXP02H2V5E.19.71.G05.1.454.CMB.2.raw
  modified_base (187)..(187): a, c, t, g, unknown or other
  modified_base (239)..(239): a, c, t, g, unknown or other
  modified_base (251)..(251): a, c, t, g, unknown or other
  modified_base (316)..(316): a, c, t, g, unknown or other
  modified_base (364)..(364): a, c, t, g, unknown or other
  modified_base (372)..(372): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtntctcgtggcgagcgggccaccatcaactgcaagtccagccacaatcttttanacagttccaaanaatagaaaactatagcttggtaccagcagagaccaggacagcctcctaggcctgctctatttacngggcataccgtacccgggaatccggggccccctgaccgtatcagtgcngcgggttnggggacagtacttcaactctacaccatcagcagcctgacaggctagagagtgtagggtctaagtttattagttagtacctaactaaattattaatttataacgttacggttacggtaaacgttttcggacttaaaacggggaccgtaaacggtacggtaatagtaaccgaagtaacgaacgtcggtagacgttacgcccg

SEQ ID NO: 430307 - DNA, 521 bp, Homo sapiens
  misc_feature: GZ8MTXP02JWDC1.19.71.G05.1.454.CMB.2.raw
  modified_base (445)..(445): a, c, t, g, unknown or other
  modified_base (464)..(464): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcactgggtcaggcagtccccatcgagaggtctagagtggctggggaagacatatttcatgtccaaacacggtaggaaatacaaaattatgacaacccaatctgttgaagagtcgaactgaacaaatacaaacgtagaacacaatacgaagaaaccaagtactcctcncagctgacctctgtcgacnccgacggacgaccggtaggtataattacgtagttaggaaggaacggacccactaacg

SEQ ID NO: 430308 - DNA, 577 bp, Homo sapiens
  misc_feature: GZ8MTXP02JOHJT.19.71.G05.1.454.CMB.2.raw
  modified_base (372)..(372): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagacggtctagagtggcgtaggggaagacattattcatcgccaaacacggtaggaaataacaaatttanacgacacctaatcgtagttagaagtacgtcgacgtagaactaactacaaacgtagaacaacagtacgaaagaaacctacgttccctccctagacacgtccgtacgacccttctacggtacgacccgttacccggacggaaccgtacggggttaattagtaacgttacgtagggtacggaaacggtaccggacccccagtaaaccg

SEQ ID NO: 430309 - DNA, 573 bp, Homo sapiens
  misc_feature: GZ8MTXP02I0QXT.19.71.G05.1.454.CMB.2.raw
  modified_base (238)..(238): a, c, t, g, unknown or other
  modified_base (249)..(249): a, c, t, g, unknown or other
  modified_base (312)..(312): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaanaatgaaaactctagcttggtaccagcagagaccaggacagcctctaggctgctcatttaccgnggcacgtccgtaccggtacgtcccggggtcccctagaccgtatcgaggtcggcgtggtcgggtcgacggacagtactttcactctacacatcagcacgcctgacgaggactagaagtgtggtacggtacttagtttattattagtaactaaactaattatttaattagtacgttcggttacggtaccgttacggaaccgtaacgggtaacgtaagggtacgaatactaacgaacgtacgtaacgtggtacgtcgtacgacc

SEQ ID NO: 430310 - DNA, 517 bp, Homo sapiens
  misc_feature: GZ8MTXP02JRYIQ.19.71.G05.1.454.CMB.2.raw
  modified_base (238)..(238): a, c, t, g, unknown or other
  modified_base (313)..(313): a, c, t, g, unknown or other
  modified_base (356)..(356): a, c, t, g, unknown or other
  modified_base (369)..(369): a, c, t, g, unknown or other
  modified_base (411)..(411): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactactagcttggtaccagcagagaccaggacagcctcctaggctgctcatttacnggcatcgtacccggatccgggtcccctgaccgattcagtggcngcgggtctggganagtatttcactctcaccatcagcagcctgcaggctagaaagntgtcggatagtttattatgtacaactaatattattatacttcgtaggtacgttcggacctaaagggaccaaaggtcgaatatcgagacgtacgtgtcggctcgacc

SEQ ID NO: 430311 - DNA, 568 bp, Homo sapiens
  misc_feature: GZ8MTXP02HYJRT.19.71.G05.1.454.CMB.2.raw
  modified_base (238)..(238): a, c, t, g, unknown or other
  modified_base (314)..(314): a, c, t, g, unknown or other
  modified_base (369)..(369): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttaccaacaatagaaaactacttagcttggtaccagcagagaccaggacagcctctaggctgctcatttacngggcatccgtaacccggggaatcccggggtcccctgacccgtattcaggtcggcngggcgggtctgggacagtactttcactctacaccatcagcagcctgcaggctagaaagtgtgtggtattagtttatattacgtactaaataatatttaattatacgttacgtacggtacgtttcggaccgtaaaggggtaaccgtaaagggtacggtaataagtaaccgaaggaacgtaacgtggtacggctaggaccc

SEQ ID NO: 430312 - DNA, 653 bp, Homo sapiens
  misc_feature: GZ8MTXP02FNDVJ.19.71.G05.1.454.CMB.2.raw
  modified_base (243)..(243): a, c, t, g, unknown or other
  modified_base (256)..(256): a, c, t, g, unknown or other
  modified_base (325)..(325): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccgatacgaactgactaagtccagccaacaatcttttaanactagtaccaaanaatagaaactactagtcttagacagacagacgaccgaggacacgcctacgtagctgctactagttacgngggactacgtcccgtaaaccgggaacgtccccggggtacctaccggaccgtattacgacggtcggaccgagggtccggggtcgtaggggaacctagtaccttacaccttctacacctatacaacgccgacgcctacgacgacgacgtagaagtagtaggtacggtacgttaagtttagtttagttagtaacgtaaactaaattaatttaattaagttacgttacggttacggttacggttacggtaccggtaaacggtaaacggtaaacggtacgtaacgtaacgtacgtaacgtaacgtaacgtacggtacgtacgtacgacgtacg

SEQ ID NO: 430313 - DNA, 584 bp, Homo sapiens
  misc_feature: GZ8MTXP02G7BRI.19.71.G05.1.454.CMB.2.raw
  modified_base (376)..(376): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgtgcttggcacgtgggtcaggcacgtccccatcgagagtctagagtggcgtagggaagacattatttcattcgtccaaacgtacgtaggaaataacgtaaatttanacgaccactaatctgttgagagtccgatagactaatacgaaacgtacgaacaacgtacgtaacgaaacgtaaaccctacgtttaccctacccttagaccaacggtcctacgacccttacgtacgtacgaccgttacccgggaacggtacgtaccgggtagttaataacgttacgtggtacggaacgaccgtaccccgtaagtaaccgg

SEQ ID NO: 430314 - DNA, 562 bp, Homo sapiens
  misc_feature: GZ8MTXP02GDC3G.19.71.G05.1.454.CMB.2.raw
  modified_base (367)..(367): a, c, t, g, unknown or other
  modified_base (505)..(505): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctagagtggctaggggaagacatatttcattgccaacacgtaggaatacaaattangacacctatcgtagttgagtagtacgactagaacaatacaaacgtagaacacatacgaaacgaaccctacgttcctaccctgacagtcctacgaaccctcgtcgtcgaccgtacccggaacggtaccgaacggggttnttaacgttaacgtttacgtaggttacgggaaacgtaccggaccccctaagtaaaccg

SEQ ID NO: 430315 - DNA, 686 bp, Homo sapiens
  misc_feature: GZ8MTXP02IUX0E.19.71.G05.1.454.CMB.2.raw
  modified_base (240)..(240): a, c, t, g, unknown or other
  modified_base (249)..(249): a, c, t, g, unknown or other
  modified_base (253)..(253): a, c, t, g, unknown or other
  modified_base (259)..(259): a, c, t, g, unknown or other
  modified_base (262)..(262): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaagtccagccacaatctttaanacatacaanatanaaactntantgacagcagacgacagacagcctcgtagctgccttactatttacgcgggtactacgttacccggtacccgggtacgtcccggggtacctacgaccgtattcgaggtcgaccgacgggtcggggtctacggggactagttactttacacttacctacctactactcgaacgcgtacgtccgtacggacgtacggtacgtaaggaacgtagttacggtacgggtactttaagttttaattacgttaacgtaaactaaacttaatttaactttaacggtttaactttaccgttacgggttaaccgggttaaccggttaccgggtaaaccggtaaaacgggggtaaaccgtaaacggggttacgtaaacttaacgtaacgaaacggtaaaccgtaacggttcggtacggtcgttaacggacctaaccg

SEQ ID NO: 430316 - DNA, 638 bp, Homo sapiens
  misc_feature: GZ8MTXP02IT9BX.19.71.G05.1.454.CMB.2.raw
  modified_base (240)..(240): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccacaattctttanacagttaccaacaatagaaaactacttagcttggaccagcagagaccaggacagcctctaggctgctctaatttacgtcggggctacgtaccgtaaccccggggaaacgtccccggggtacccccctagaacccgtattccgaggtcggacgacgggtccgggggttctacgggggacctaggtacttttccgaccttcctaccaccctatcacgcacgccctgcgaggctagaaagtgtggtacggcttaagttttataatttgtaaccaaattaattatttaattactaacgttcggttacggttacggttaccgggaaccgtaaaacggggtaaccgtaagggtacgtaataagttaaccgaagaacggtaacgtggtacggtcttacggaaccc

SEQ ID NO: 430317 - DNA, 506 bp, Homo sapiens
  misc_feature: GZ8MTXP02JGR8K.19.71.G05.1.454.CMB.2.raw
  modified_base (344)..(344): a, c, t, g, unknown or other
  modified_base (363)..(363): a, c, t, g, unknown or other
  modified_base (471)..(471): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcactgggtcaggcagtccccatcgagagtctagagtggctgggaagacatatttcatgtccaanacgtagaatacaaatttangacacatctagttgagtagtcgactgacaatcaaacgtagactacatacgaagaaccagttcctacctgacagctgaccctctgtcgacctccggaggacacgggttntataacgtacgtagtacgacgaccgacccagtacg

SEQ ID NO: 430318 - DNA, 626 bp, Homo sapiens
  misc_feature: GZ8MTXP02HLYQ6.19.71.G05.1.454.CMB.2.raw
  modified_base (246)..(246): a, c, t, g, unknown or other
  modified_base (258)..(258): a, c, t, g, unknown or other
  modified_base (329)..(329): a, c, t, g, unknown or other
  modified_base (383)..(383): a, c, t, g, unknown or other
  modified_base (446)..(446): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccgatacaactgacaagtccagccactaatcttttaanactactaccaanaatacgaaaactacttagtcttacggaccagacagacgaccaggacacgcctcgagctgctactattacgngactacgtaccgtaccggacgtcccgggtcccacgaccgtatcgaggtcggcgngggtcgggtacgacgggactagtacttaccactcctacaacctagtacgacgccgacgtccgnggacgaggactaggaagtagttacggtaggttacttaagttttattagttacgtaactaaattaatttaagtttaatttaacgttacgttacggtacggtacccggttacggaaccgtaaacgggtaacgtaagggtactaagtacgaacgaacgtaacgtacgtggtacgacgtacgac

SEQ ID NO: 430319 - DNA, 532 bp, Homo sapiens
  misc_feature: GZ8MTXP02F5MXU.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcactgggtcaggcacgtccccatcgagagtctagagtgctggggaagacatatttcatgtaccacgacgtaggaaatacaaattatgacaccatctgttagagagtacgactgaacaatacaaacgtagacaacatacgaaacgaacctagttacctccctagcaagctgacctctagtcgaccgtcccggaaggacgtacggggtataacgttaattaacgtggtacggaaacgaccggaccccaagtacgaacg

SEQ ID NO: 430320 - DNA, 677 bp, Homo sapiens
  misc_feature: GZ8MTXP02GRTAV.19.71.G05.1.454.CMB.2.raw
  modified_base (217)..(217): a, c, t, g, unknown or other
  modified_base (238)..(238): a, c, t, g, unknown or other
  modified_base (247)..(247): a, c, t, g, unknown or other
  modified_base (252)..(252): a, c, t, g, unknown or other
  modified_base (285)..(285): a, c, t, g, unknown or other
  modified_base (296)..(296): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactcctggctgtgtctcgtgggcgaggcggccacgatacgaactganaagtcagccataatctttaanacatacaanaatanaactactagctacgacagacagacgacgagacncgctcgagctnctactagttacgcggactacgtaccgtaccggacgtcccggtcctacgaccgtacgtcgacggtcggacgtacgggtcgggtacgtacggaactacgtacttacaccttacctaccgaacctactacgaacgcgaccgaccgtacgacgacggtacgtagtaacgtaggtacggtacggttacgtttaacgtttaagtttaacgttaacgttaaacgttaaacttaaactttaaactttaaactttaacgtttaacgtttacggttacggttaccggttaccggtaaaccggtaaacgggtaaacggtaaacggtaacggtaacgtaacgtaacgtaaacggtaacgtaacggtacggtacggtacgtacgtaccgtaccg

SEQ ID NO: 430321 - DNA, 633 bp, Homo sapiens
  misc_feature: GZ8MTXP02HTYJ7.19.71.G05.1.454.CMB.2.raw
  modified_base (228)..(228): a, c, t, g, unknown or other
  modified_base (237)..(237): a, c, t, g, unknown or other
  modified_base (247)..(247): a, c, t, g, unknown or other
  modified_base (257)..(257): a, c, t, g, unknown or other
  modified_base (299)..(299): a, c, t, g, unknown or other
  modified_base (308)..(308): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcattttctctgttgctctggatctctggtgcccacggggacatcgtgatgacccagtctccagactccctggctgtgtctctgggcgagcgggcaccatcgaactgacaagtccagccanaatctttanacataccaanatagaaactntagcttagacagcagacgaccagacacgcctcgtagctgctntatttacgnggacactccgtaaccgggacgtcccggggtcctagaccgtattcgaggtcggcgtacgggtccggggttacgtgggaactagttactttccactcctacacctatcagcacgtccgtgacgaggctagaagtagttggtacgtacgtttagttttattacgttacgtaactaaacttaaatttaatttaacgtttaacttacgtttacggttaacgggttaaccggtttaccgggaaaccggtaaacggggtaacgttaaacgggtacggtaacttacgtaacgaacggtaacgtaacgttggtacggtacgtacgtactaaccg

SEQ ID NO: 430322 - DNA, 620 bp, Homo sapiens
  misc_feature: GZ8MTXP02JI1UT.19.71.G05.1.454.CMB.2.raw
  modified_base (247)..(247): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcagaccctctcgctcacctgtcgccagtcgtccggggacagagtcgctagcgacngtgttgcttggcacgtgggtcaggcacgtccccagtcgagtggtctaggagtggcgtaggggaaagtacgtattatttcattcgtaaccaaacgacggtaggaaacttaactaaaattatacgacaaccgtaattccgtaggttagaaggtacgtacgtaactagaaactaaatacgtaaacgtaacgaacaactaacgtaacgaaacgaaaccgtaacgtttcctaccctgaccacgctacgacctgtcggtacaccgtcccggaggtacgtacggtagttagtaacgtagtacggtaggaacggtaccgacccgtaagtacgacagtacgaaccgtaccgtcgttccgtcgtcggtacgtacgtttaacgg

SEQ ID NO: 430323 - DNA, 579 bp, Homo sapiens
  misc_feature: GZ8MTXP02HIQQJ.19.71.G05.1.454.CMB.2.raw
  modified_base (314)..(314): a, c, t, g, unknown or other
  modified_base (363)..(363): a, c, t, g, unknown or other
  modified_base (373)..(373): a, c, t, g, unknown or other
  modified_base (381)..(381): a, c, t, g, unknown or other
  modified_base (427)..(427): a, c, t, g, unknown or other
  modified_base (432)..(432): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttaccaacaatagaaaactacttagcttggaccagcagagaccaggacagcctctaggctgctcatttacgnggcatccgtacccggggatccggggtcccctgaccgtattcgagtggcnggtccgggtntggggacngtactttcactctcacctatcagtcagccctgccaggctagaaagnttggnggtactagtttattagttgtactaaataattaattattattacgttacggttacggtaccgtttcggaaccgtaaaggggtaacccgtaagggttcggaaactttacgaaccgaaggtacccggaacgttggcggtacttcgacccg

SEQ ID NO: 430324 - DNA, 616 bp, Homo sapiens
  misc_feature: GZ8MTXP02GQYG0.19.71.G05.1.454.CMB.2.raw
  modified_base (73)..(73): a, c, t, g, unknown or other
  modified_base (228)..(228): a, c, t, g, unknown or other
  modified_base (237)..(237): a, c, t, g, unknown or other
  modified_base (246)..(246): a, c, t, g, unknown or other
  modified_base (250)..(250): a, c, t, g, unknown or other
  modified_base (256)..(256): a, c, t, g, unknown or other
  modified_base (267)..(267): a, c, t, g, unknown or other
  modified_base (302)..(302): a, c, t, g, unknown or other
  modified_base (330)..(330): a, c, t, g, unknown or other
  modified_base (338)..(338): a, c, t, g, unknown or other
  modified_base (361)..(361): a, c, t, g, unknown or other
tcagtactctcgtgcacgaccggtgctcgatttagtgtcgtcgcaagagagaggggggtacaacaggcaggcnggggcagcaagatggtgttgcagacccaggtcttcatttctctgttgctctggatctctggtgcccacggggacatcgtgatgacccagtctccagactccctggctgtgtctcgtgggcgagccgggccaccatcaactgacaagtccagccanaatctttanacatacaanatanaaactntagctagacancagacacagacacgcctcgagctgctctattacgnggacactccgaaccggatcccgggtccncgaccgtntcgagtcggcgagggcgggtcgnggactagtcttccactcacaccatcgagcacgcctgacgacggctagaagtagttggtacggtaacgtttaagttttaagtttacgttacgtaaacctaaaattaaatttaaatttaaacgtttaacgtttaccgtttacggttacgggttaaccggttaccgggaaaccggtaaaacggggtaaccgtaaagggtacgtaaacttaacgtacgaaaaggtaccgtaaacgtggtacggacgtacgtaccgtacg

SEQ ID NO: 430325 - DNA, 738 bp, Homo sapiens
  misc_feature: GZ8MTXP02JWNOS.19.71.G05.1.454.CMB.2.raw
  modified_base (240)..(240): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcaactgcaagtcagccactaatcttttaanactacgtaccaaactaatacgtaaaactacttacgcgttacggtaccagacaagacgaccgaaggacacgtcctacgtaggctgaccttactaacgtttacgcggactacgttacccgtaacccggggtaacgttccccggggtaccccctagtaccgtattacgagggtcggacgtcggggtccggggttcgtacggggaactagttactttcccacttcctaccgtaacctactacgacgtccaccgtccgtaggaccgaggtcgtaaggaaaggtgttacgggtacggttaacgtttaagtttttagttaacgttacgtaaaccttaaaacgttaatttaacgtttaacgtttaacgtttaccgtttacgggttaccgggttaccggttaccgggaaaccgggtaaaacgggtaccggtaaaggggttacgtaaacgttaacgtaaccggtaaacggttaaccggtacggttacggacggtaccgtacgtacccg

SEQ ID NO: 430326 - DNA, 579 bp, Homo sapiens
  misc_feature: GZ8MTXP02IA5ZG.19.71.G05.1.454.CMB.2.raw
  modified_base (187)..(187): a, c, t, g, unknown or other
  modified_base (242)..(242): a, c, t, g, unknown or other
  modified_base (266)..(266): a, c, t, g, unknown or other
  modified_base (321)..(321): a, c, t, g, unknown or other
  modified_base (455)..(455): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtntctcgtgggcgagccgggccaccatcaactgcaagtccagccactaatcttttanacagttccaaacaatagaaaactntagctggtaccagacagacgaccaggacacgcctctaggctagctacatttacgnggcactccgtaaccccgggaatccggggtccccctagacccggtattccgagtcggcagggtccggggttctagggggacctaggtactttcaacctcctcaacctatcagccaagccctgcaggctagaaagnttggtggtattagtttatattgaactaaatattatttatatacgttcgtaggaacgttcggacaaaggggacctaagggtacgtatacgtaacgaagtaaccgtaatggtacggacctgacccg

SEQ ID NO: 430327 - DNA, 650 bp, Homo sapiens
  misc_feature: GZ8MTXP02FTDLG.19.71.G05.1.454.CMB.2.raw
  modified_base (240)..(240): a, c, t, g, unknown or other
  modified_base (249)..(249): a, c, t, g, unknown or other
  modified_base (254)..(254): a, c, t, g, unknown or other
  modified_base (264)..(264): a, c, t, g, unknown or other
  modified_base (282)..(282): a, c, t, g, unknown or other
  modified_base (307)..(307): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccacaatctttaanacatacaanaatanaaactatagntgacagcagagacagacncgcctacgagctgctactattacgngggactacgtaccggtaccggaacgtccccggggtacctacgaccgtatcgagtcgcgacggtcgggtcgtacggacgtacgtacttactactctacacctactacacgacgacgccgtacgacgacggtacgtagaagtagtaggttacggttacgttaagttttaagtttaacgtttaacgttaacgtaaacttaaatttaaatttaaactttaacgtttaacgtttacggttacggttaaccggttaccggtaaccggtaaacggtaaacggtaaacggtaacgtaacgtaacgtaacgtaacgtaacgtaacgtacggtacggtacgtacgtacgtacg

SEQ ID NO: 430328 - DNA, 621 bp, Homo sapiens
  misc_feature: GZ8MTXP02JBB1C.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgttgcttggcacgtgggtcaggcacgtccccatcgagtacggtctaggagtggcgtggggaagactatatttcattcgtccaaacgtacggtagaaataactaaatttatcgacctaaccgtatcgttagttagaagtacgtacgacgtagaactaatacgaaacgtacgaacaacgtacgtaaccgaaacgaacctacgttaccctacccgtacgacaacggtcctacgtacccgttacgtcggtaccgacccgttacccgggaacggtacccgtaacggggttagttaaacgttaacgttacgtacggttaacgggaacggacccggtacccccgtaagtaaacccgg

SEQ ID NO: 430329 - DNA, 648 bp, Homo sapiens
  misc_feature: GZ8MTXP02G9EDY.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatccgtccggggacagacgtcgctagcgacagtgttcgcgttggctacgtggtcaggcacgtccccatcgagagtctaggagtggcgtaggggaagactagttatttcagttcgtaccaaacgtacggtaggaaattaacgtaaaatttatacgtacctaaccctattcgtaggttacgaagtacgttaccgaacttagaacctaaacttaccgaaacggttaacgaaaccaactaacgtaaccgaaaacggtaaaccctaggtttaccctaccccgtaggtacccacgtaccgtaccgtacccgttcgtacggtaccgacccgtaccgggaacggtaaccggtacgggttactaacgttaacgttacggtacgggtaacggaaccggacccggtacccgtaagtaacg

SEQ ID NO: 430330 - DNA, 632 bp, Homo sapiens
  misc_feature: GZ8MTXP02JPCNL.19.71.G05.1.454.CMB.2.raw
  modified_base (244)..(244): a, c, t, g, unknown or other
  modified_base (342)..(342): a, c, t, g, unknown or other
  modified_base (409)..(409): a, c, t, g, unknown or other
  modified_base (456)..(456): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacgaactgactaagtccagccaactaattcttttaanactacgttaccaaactaagtaacgaaaactacttagtcgttacggaccagacaagacgaccgaggactacgcctacgtaggctgctactagtttacgnggactacgtaccggtaaccggggtacgttcccggggtacccctaggaccgtattcgaggtcggacgnggggtccgggtagtacgggactagttacttcacctcctaccactacncgagacgacgcgacgacgacgacgagtagtagtggtgtagttagttattagttagtaactaataattaattaattacttacgttacggttacggtacggtacggtaacggtaacggtaacgtaacggtacgtaagtacgtaacgtaacgaacgtacgtacgtacgtacgtacgacg

SEQ ID NO: 430331 - DNA, 504 bp, Homo sapiens
  misc_feature: GZ8MTXP02JK6K2.19.71.G05.1.454.CMB.2.raw
  modified_base (345)..(345): a, c, t, g, unknown or other
  modified_base (425)..(425): a, c, t, g, unknown or other
  modified_base (475)..(475): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatctccggggacagagtcgctagcgacagtgttgcttggcactggggtcaggcagtccccatcgagaggtctagagtggctggggaagcagtatttcatgtaccacncgtggaaatacaaattatgacaccatctgttgagagtcactgaacaatacaacgtagacacatacgaagaaccagttccncctgcagctagactctgtcactacccgagactacgggtctatattaacgnggtacggaacgacggaccccagtacgaac

SEQ ID NO: 430332 - DNA, 526 bp, Homo sapiens
  misc_feature: GZ8MTXP02H4L36.19.71.G05.1.454.CMB.2.raw
  modified_base (236)..(236): a, c, t, g, unknown or other
tcagtactctcgtgcacgaccggtgctcgatttagtgtcgtcgcaagagagagggggagatacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctctaggctgctcatttactggcatcctaccgggaatccccggggtccctgaccgattcagtggcagcgggtctgggacagatttcactctcacatcagcagctgcagctgagatgtggctagtttattattgtcaactaattattaattattaactttcgtggtaacgtttcggaccgttaaacgggaccgaaaggttggaataagtacgaagaccgtaaagtcggtaggactcg

SEQ ID NO: 430333 - DNA, 656 bp, Homo sapiens
  misc_feature: GZ8MTXP02G1FXT.19.71.G05.1.454.CMB.2.raw
  modified_base (246)..(246): a, c, t, g, unknown or other
  modified_base (336)..(336): a, c, t, g, unknown or other
  modified_base (454)..(454): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaacgtccacgaccaactaattctttanactacgttaccaaacaatacgaaaactacttagcttacggaccagacaagacgaccaggacacgcctccgtaggctgctactatttacgnggactacgtaccgtacccgggaacgttcccggggaccccctaggaccgtacttcgaggtcggcacggggtcgggtacgtcggggaacctaggttactttccaccttcctacaacctancgacgcacggtcctcggacgaggtaccgtagaaacgtgttgggtcggtattagttttagttattacgtaactaaaattaattaatttaattacgttaacgttcggtacgggtaccgttacgggaaccggtaaacggtaccggtaaaggtagaacttacgaacgtaaacggtaaccgtaacggtggtacggacctcgaacccg

SEQ ID NO: 430334 - DNA, 496 bp, Homo sapiens
  misc_feature: GZ8MTXP02G72JQ.19.71.G05.1.454.CMB.2.raw
  modified_base (234)..(234): a, c, t, g, unknown or other
  modified_base (308)..(308): a, c, t, g, unknown or other
  modified_base (358)..(358): a, c, t, g, unknown or other
  modified_base (428)..(428): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactactagcttggtaccagcagacgaccaggacagcctctaggctgctcattacngggcatctaccgggatccggggtcctcgaccgattcagtgcagcgggtcngggacagtattcactctcacatcagcacgctgcaggctagaagatgtggactagtttattattgtacaanaattatattatactcgtgtacgttcgacaggacaaggtgactatagaagacgaacgtgagctagcaac

SEQ ID NO: 430335 - DNA, 554 bp, Homo sapiens
  misc_feature: GZ8MTXP02F3LOF.19.71.G05.1.454.CMB.2.raw
  modified_base (326)..(326): a, c, t, g, unknown or other
  modified_base (374)..(374): a, c, t, g, unknown or other
  modified_base (389)..(389): a, c, t, g, unknown or other
  modified_base (401)..(401): a, c, t, g, unknown or other
  modified_base (434)..(434): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgcaagtccagccacaattcttttaatacagttaccaaactaaatagaaaactacttagcttaggtaccagcaagacgaccaggacagcctcaggctgctcatttacgngggcatccgaccgggaatccggggtcccctgacccgattcaggtcgcnggcgggtctgggacngtatttcactcncaccatcagcagccctgactaggacagaaagtntaggtggacttaagtttatattagtacaataattaattattattacgtcgtagtacgttcggaccgtaaagggacctaaggtcgaatagtaacgaagtaacgaactggtacgctagaccg

SEQ ID NO: 430336 - DNA, 586 bp, Homo sapiens
  misc_feature: GZ8MTXP02GULI9.19.71.G05.1.454.CMB.2.raw
  modified_base (242)..(242): a, c, t, g, unknown or other
  modified_base (317)..(317): a, c, t, g, unknown or other
  modified_base (368)..(368): a, c, t, g, unknown or other
  modified_base (413)..(413): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaagtccagccacaatcttttanactattccaacaatagaaaactacttatcttggtaccagcagagaccaggacagcctctaggctgctcatttacnggctagtctacccggggatccggggtccccctgaccgtattcgagtcggcnggcgggtctggggacagtatttcactctcaccatccagcagcccncgcgacgcgtagagagtgtggtacgttagtttagttattagtactaactaattaatttaatttaacgttacgttacggttacggttacggttacggtaccggtaacggtaacggtaacggtacggtagtaacgtaacgtaacgtaacgtaacgtaggtacggtacgtacgtcg

SEQ ID NO: 430337 - DNA, 586 bp, Homo sapiens
  misc_feature: GZ8MTXP02I54DN.19.71.G05.1.454.CMB.2.raw
  modified_base (243)..(243): a, c, t, g, unknown or other
  modified_base (254)..(254): a, c, t, g, unknown or other
  modified_base (259)..(259): a, c, t, g, unknown or other
  modified_base (316)..(316): a, c, t, g, unknown or other
  modified_base (368)..(368): a, c, t, g, unknown or other
  modified_base (382)..(382): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccgatacgaactgacaagtccagccacaatcttttaanacagtaccaanaatanaaactatagcttagacagacagacgacagacacgcctcgagctgctactatttacgnggactacgtccgtaacccgggagtcccgggtaccctagaccgtagttacggngacgaggtcgggtntagggaactagtacttcactctacactatcagcacgcgtcgcgacgacgagaagagtagtagtacgttagtttattagttagtactaactaattaattattattacgttacgttacggtacggttacggtacgtaacggtaacgtaacggtacgtacgtagtacgtaacgtaacgtaacgtacgtacgtacgtacgtacgtacg

SEQ ID NO: 430338 - DNA, 599 bp, Homo sapiens
  misc_feature: GZ8MTXP02HG1XG.19.71.G05.1.454.CMB.2.raw
  modified_base (410)..(410): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgtgcttggcacgtggtcaggcacgtccccatcgagagtctagagtggctgggaagactatatttcatcgtccaacacgtagaatacgtaaattatcgacacatctagtgagtagtcgatagaactaagtacgaaacgtanaacaactaagtaccgaaaacgtaacccgtaacgttccctaccctagaccaacgtccgtacgtaacccttcgtacggtaccgtacccgtacccgggaacggtaacccggtaacggggttaacttaaacgttaacgtttaacggtacgggttaacgggaaacggtacccgggaccccctaaaggtaacccg

SEQ ID NO: 430339 - DNA, 537 bp, Homo sapiens
  misc_feature: GZ8MTXP02GS1BM.19.71.G05.1.454.CMB.2.raw
  modified_base (254)..(254): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagngtaacgctagcgacagtgttgcttggcacgtgggtcaggcacgtccccatcgagaggtctagagtggcgtggggaagacattatttcattgtccaaacacggtaggaaataacaaattatgacacatctagttgagagtcgactgacaatacaaacgtagacacatacgaaagaaccacgttcctaccctagcagctacgacctcgtacgtacgaccgtacccggacggacgtacgggtagtaactaagttacgtaggtacggaacgacggaccccagtaacg

SEQ ID NO: 430340 - DNA, 524 bp, Homo sapiens
  misc_feature: GZ8MTXP02FN4EA.19.71.G05.1.454.CMB.2.raw
  modified_base (313)..(313): a, c, t, g, unknown or other
  modified_base (360)..(360): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaaacaatgaaaactacttagcttggtaccagcagagaccaggacagcctcctaggctgctcatttacngggcatctacccgggaatccggggtccccctgaccgattcagtggcnggcgggtctggggacagtatttcactctcaccatcagcagcctgcagggctgaaagatgtggctagttttattattgtacaaacaattattattatacgttcgtggtacgttcggaccaaaggggaccaagggtgaatataacgagacgaactgtcggctgacc

SEQ ID NO: 430341 - DNA, 556 bp, Homo sapiens
  misc_feature: GZ8MTXP02FQPFN.19.71.G05.1.454.CMB.2.raw
  modified_base (237)..(237): a, c, t, g, unknown or other
  modified_base (311)..(311): a, c, t, g, unknown or other
  modified_base (357)..(357): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctctaggctgctcatttacnggcatccaccgggatccggggtcccctagaccgattcgagtcggcnggcgggtctggggacagtatttccactctcaccatcagcagcctgcaggctagaaagatgtggactagtttattattcgtacaaactaattattattattacgttcggtacggtacggtttcggaccgtaaaagggggacctaaaggggtcgaattaacgtaacgaacgtaacgtaaacgtggtacggcttacggaacc

SEQ ID NO: 430342 - DNA, 499 bp, Homo sapiens
  misc_feature: GZ8MTXP02FU84H.19.71.G05.1.454.CMB.2.raw
  modified_base (235)..(235): a, c, t, g, unknown or other
  modified_base (307)..(307): a, c, t, g, unknown or other
  modified_base (368)..(368): a, c, t, g, unknown or other
  modified_base (430)..(430): a, c, t, g, unknown or other
  modified_base (447)..(447): a, c, t, g, unknown or other
  modified_base (476)..(476): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaacaatgaaaactactagcttggtaccagcagagaccaggacagcctctaggctgctcattacnggcatctacccgggaatcccggggtcctcgaccgattcagtggcagcgggtctgggacagntttcactctcaccatcagcagcctgcaggctagaagatgtgactagtttattattgtacaanattattatatacttcgngtacgtcggacaagggtacaagtggaatntacaagacaactgaggctgacac

SEQ ID NO: 430343 - DNA, 526 bp, Homo sapiens
  misc_feature: GZ8MTXP02ILU5O.19.71.G05.1.454.CMB.2.raw
  modified_base (235)..(235): a, c, t, g, unknown or other
  modified_base (310)..(310): a, c, t, g, unknown or other
  modified_base (430)..(430): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaacaatgaaaactacttagcttggtaccagcagagaccaggacagcctcctaggctgctcatttacngggcatcctacccggaatccggggtcccctgaccgattcagtgcaggcgggtactgggacagtatttcactctcacccatcagcagccctgcaggctgaagatgtggctagtttatagtnacaataattattattatacttcgtagtacgttcggactaaaggggacctaaggtaggattagtaaccgaagacgaaactggtcggtactacgaacc

SEQ ID NO: 430344 - DNA, 566 bp, Homo sapiens
  misc_feature: GZ8MTXP02GXDTZ.19.71.G05.1.454.CMB.2.raw
  modified_base (308)..(308): a, c, t, g, unknown or other
  modified_base (373)..(373): a, c, t, g, unknown or other
  modified_base (400)..(400): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggcacgtgggtcaggcacgtccccagtcgagnggtctaggagtggcgtaggggaagactagttattcatgtaccacgcgtaggaaataacaaattangactactatactgtgagagtagactanagaactacaacgtaagacaacacgtaacgaacgaaacctaccgttactccctacgacgacgacgtaccgtaccgtacctcgtacgtaccgtacccggacggacgtaccgggtagttacttaacgtaacgttacggaggtaacgacggaccctacgtacggtaaccg

SEQ ID NO: 430345 - DNA, 563 bp, Homo sapiens
  misc_feature: GZ8MTXP02FN1U0.19.71.G05.1.454.CMB.2.raw
  modified_base (317)..(317): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgtgcttggcacgtgggtcaggcacgtccccatcgagaggtctagngtggcgtaggggaagacattatttcatcgtccaacgacgtaggaaataactaaattatcgacacctatcgtagttagagtagtacgactagaacaatacaaacgtacgaactaacagtacgaaacgaacctacgttcctacctagacagtactcgacctcgtcgtacgtaccgtacccggaacggaccgtacgggtcgtaacgttaacgttacgtaggtacggaacgaccggacccctaagtaacg

SEQ ID NO: 430346 - DNA, 503 bp, Homo sapiens
  misc_feature: GZ8MTXP02I1KTE.19.71.G05.1.454.CMB.2.raw
  modified_base (280)..(280): a, c, t, g, unknown or other
  modified_base (396)..(396): a, c, t, g, unknown or other
  modified_base (438)..(438): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactggtcaggcagtccccatcgagnggtctagagtggctgggaaggacatatttcatcgtaccaacacgtagaatacaaattatgcaccatctgtgagagtcactgacaatcaagtagacacatacgaagaaccagttccncctgcagctcgtacctctgtagacctcccgaggacacgggtntatattactgtaggaagacggccccagtacgacatcgccacctcgtctcgtcggtcgtcttaacg

SEQ ID NO: 430347 - DNA, 549 bp, Homo sapiens
  misc_feature: GZ8MTXP02IZ0O0.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtgggtcaggcacgtccccatcgagaggtctagagtggcgtggggaagactatatttcattcgtccaacgacgtaggaaatactaaattatgacacctatctagttgagtagtcgactagaacaatacaaagtagacacatacgaaagaaccacgttcctacctgacagctcgtacctctcgtacgaccgtacccggaacggtaccgtacgggttagttaattaacgttacgtaggtacggaacggaccggacccctaagtaaccg

SEQ ID NO: 430348 - DNA, 535 bp, Homo sapiens
  misc_feature: GZ8MTXP02GYZ30.19.71.G05.1.454.CMB.2.raw
  modified_base (235)..(235): a, c, t, g, unknown or other
  modified_base (243)..(243): a, c, t, g, unknown or other
  modified_base (247)..(247): a, c, t, g, unknown or other
  modified_base (253)..(253): a, c, t, g, unknown or other
  modified_base (256)..(256): a, c, t, g, unknown or other
  modified_base (268)..(268): a, c, t, g, unknown or other
  modified_base (299)..(299): a, c, t, g, unknown or other
  modified_base (357)..(357): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccaccatcaactgcaagtccagccacaatctttanacatcaanatanaaactntanctgacagcaganacagacagcctcaggctgctactatttacgnggcatccgtaacccgggaagtcccggggtcccccacgaccgtattacgaggtggacgngggtcgggtctaggggacagtactttcactctacaccatcagcacgcctgcagctagaagtgtgtgtactagtttatattcgtacaaataattattattacgtacgttgtacggtacgttcggaccgaaagggtaccaaggtgaatacgaacgaacgaacgtaactggtacgctacgc

SEQ ID NO: 430349 - DNA, 627 bp, Homo sapiens
  misc_feature: GZ8MTXP02FRRKT.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacagtgtgcttggcactgggtcaggcacgtccccatcgagaggtctagagtggctaggggaagacatatttcatgtccaacacgtaggaaatacaaattatcgacactatcgtgttagagacgtcgactagaacaactacaaacggtaacgacaaacgtagtaaccgaaaacggtaaaccctacgtttacctaccccgttaggaccgaacgtccgtacggtaacccttcgttacgttaccggaaccgttacccccgggaaaggggtaacccgtaaccgggggttattaacgttaacggttttaacccgtacgggttaacggggaaaacggacccggggtaaccccccaaggttaaaacccgg

SEQ ID NO: 430350 - DNA, 600 bp, Homo sapiens
  misc_feature: GZ8MTXP02I78FP.19.71.G05.1.454.CMB.2.raw
  modified_base (230)..(230): a, c, t, g, unknown or other
  modified_base (239)..(239): a, c, t, g, unknown or other
  modified_base (319)..(319): a, c, t, g, unknown or other
  modified_base (376)..(376): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgacaagtccagccanaatctttanacagttaccaacaatagaaaactactagcttgaccagcaagagaccaggacacgcctccgtaggctgcctacatttacgngggcactccgtaaccccggggaatcccggggtccccctagacccgtattcagtggcnggcgggtctgggacagtactttcactctacaccctatcagcacgccctagcgaggtcagaaagagtggacggtctaggtttattagttagtacctaaaataattaattaatttagtaacgttcgtacggtaaccgtttccggaaccgtaaaagggggtaccctaaaggggttacggaacttaagtaaccgtaagaaccgtaaacgtggtcgtaccgtgaacccg

SEQ ID NO: 430351 - DNA, 627 bp, Homo sapiens
  misc_feature: GZ8MTXP02JWIDY.19.71.G05.1.454.CMB.2.raw
  modified_base (228)..(228): a, c, t, g, unknown or other
  modified_base (238)..(238): a, c, t, g, unknown or other
  modified_base (248)..(248): a, c, t, g, unknown or other
  modified_base (253)..(253): a, c, t, g, unknown or other
  modified_base (308)..(308): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccanaatcttttanacataccaanaatanaaactctagcttgacagcagacgacagacagcctcgaggctgctactatttacgnggactactccgtaccgggacgttcccggggtcccctaggaccgtattcgaggtcggcgtacgggtccgggtacgtacggggaactagtactttaccaccttcctacctaacctactacgacgacgacgaccgtcgacgacggacgtacgaagtagtaggtacggtacgttagtttagtttagttacgtactaactaaattaatttaatttaattacgttacggttacggttacggttaccggtaccggtaaacggtaacggtaacggtacggtaagtacgtaacgtacgtaacgtacgtacgtacggtacgtacgtacg

SEQ ID NO: 430352 - DNA, 608 bp, Homo sapiens
  misc_feature: GZ8MTXP02GJ625.19.71.G05.1.454.CMB.2.raw
  modified_base (225)..(225): a, c, t, g, unknown or other
  modified_base (233)..(233): a, c, t, g, unknown or other
  modified_base (310)..(310): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanatctttanacagttccaacaatagaaaactactagctaggtaccagcagagaccaggacagcctcgtaggctgctctatttacgngggacatccgtacccggggaactcccggggtaccctacgaccgtattcgaggtggaccaggcggggtctaggggacagtattcactctacactatcagcagcctgcacggactagaagtagtgtaggtacttagtttattaagttagtacctaaaataaattaatttaatttacgttaacgtttacggttacggtaaccggttccgggtaacccggtaaaacggggtaaccgtaaaggggtacggtaaactaagtaacgaagtaaacgtaaacgtcggtaggtctacggacctaaccg

SEQ ID NO: 430353 - DNA, 543 bp, Homo sapiens
  misc_feature: GZ8MTXP02JTB8X.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctggggaagacatatttcatgtccaaacacgtggaatacaaattatgcaccatctgttgagagtcgactgaacaatcaaacgtagacacatacggaaagaacctagttcctaccctgcaagcttagacccttcgtacgtacgaccgtacccggaaggaccgtacggggttataacgttaagtttacgtaggtacggaaacgtaccgggtacccccaagttaaaccg

SEQ ID NO: 430354 - DNA, 690 bp, Homo sapiens
  misc_feature: GZ8MTXP02IRAUD.19.71.G05.1.454.CMB.2.raw
  modified_base (245)..(245): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggccgggccacgatacgaactgacaagtccagccacaattctttttaanactacgttacccaaataatagtaaaactacttagtcttacggtaccagacaagacgaccgaaggacacgcctacgtaggctgctactactttacgtggactacgtaccgtaacccggggaacgtccccggggtccccctagacccgtattacgaggtcggacgcgggtcgggtcgtacggggactagtactttacacgtcctacacctatacgacgaccacgccgtacgacgtacggtacgtaggaagtagttggtacggttactttaagtttaacgttagttacgtaactaaattaactttaatttaattacgttaacgttacggttacggtaaccggtttaccggaaacccggtaaacggggtaaaccgtaaagggttaacggttaacttaacgtaacggtaaacgtaaaccggtaacgtaggtaccggtacgtacgtaaccg

SEQ ID NO: 430355 - DNA, 587 bp, Homo sapiens
  misc_feature: GZ8MTXP02GWSPP.19.71.G05.1.454.CMB.2.raw
  modified_base (232)..(232): a, c, t, g, unknown or other
  modified_base (241)..(241): a, c, t, g, unknown or other
  modified_base (374)..(374): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccanaatctttanacagttccaacaatagaaactactagcttggtaccagcagagaccaggacagcctctaggctgctcatttacgtgggactatccgtaacccggggaattcccggggtcccctgaccgtattccgagtcggacnggtcgggtctggggaccagtatttccactctcaccatcagcagcctcgcgacgcgtagaagtagtagtggtagtagtttattattagtactaactaataattattattacgttcgttaggtacggttacggtaccgtaacggtaaccggtaacggtacggtaagttaacgtaacgtaacgtaacggtaacgtacggtacggtacgtacgtacg

SEQ ID NO: 430356 - DNA, 541 bp, Homo sapiens
  misc_feature: GZ8MTXP02H5D00.19.71.G05.1.454.CMB.2.raw
  modified_base (433)..(433): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgcccatcgtccggggacagagtcgctagcgacagtgttgcttggcacgtggtcaggcagtccccatcgagagtctagagtggcgtggggaaggactatagtttcagttcgtccaaacgacggttaggaaattaaccgaaattatagaccaacctatctgttagagtagtcgactagaacatacaaacgtagaactanatacgaacaaccacgttcctaccgtagcacgtctcgtacctctcgtacacctaccggagtacgacggttagattaagtacgtaggtacgacgaccggacccaagtacg

SEQ ID NO: 430357 - DNA, 553 bp, Homo sapiens
  misc_feature: GZ8MTXP02JDVPI.19.71.G05.1.454.CMB.2.raw
  modified_base (351)..(351): a, c, t, g, unknown or other
  modified_base (375)..(375): a, c, t, g, unknown or other
  modified_base (418)..(418): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatccgtccggggacaggagtcgctagcgacagtgttgcttggcacgtgggtcaggcagtccccatcgagaggtcagagtggctggggaagacattatttcattgtcccaanacggtaggtaaatacgaaatttangacacatctgttagagagtcgactgacaatcaaacgtagacanatacgaagaaccagttcctaccgtgtcaggtctcgaccttcgtcgtagacccttacccggaggaaccgtacgggggttactaacgttaagttaaccgtaggttacggaacggaccggaccccctaagttaaccgg

SEQ ID NO: 430358 - DNA, 534 bp, Homo sapiens
  misc_feature: GZ8MTXP02H89TQ.19.71.G05.1.454.CMB.2.raw
  modified_base (238)..(238): a, c, t, g, unknown or other
  modified_base (314)..(314): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttccaaacaatagaaaactacttagcttggtaccagcagagaccaggacagcctctaggctgctcatttacngggcatccgtacccgggatccccggggtcctgaccgattcagtgcagcgggtctgggacaggatttcactctacaccatcagcagcctgccaggctagaaagatgtggctagtttattattgtacaaataaattattaattacttactttcggtaggtacgtttaccgggacaaacggggtacaagggtgaataagtacgagacgtaatcggtaggctcg

SEQ ID NO: 430359 - DNA, 632 bp, Homo sapiens
  misc_feature: GZ8MTXP02FRNL0.19.71.G05.1.454.CMB.2.raw
  modified_base (234)..(234): a, c, t, g, unknown or other
  modified_base (244)..(244): a, c, t, g, unknown or other
  modified_base (255)..(255): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacgaactgactaagtccagccanaattctttanacagttccaanaatgaaaactcttagcttaggaccagcagagaccagacagcctctaggctgctcatttacgnggactacgtccgaaccggtacgtccggtcccctacgaccgtattcgaggtcgacgcgggtcgggtacgtagggaacctagttactttaccacttacctaccaacctagtactacgacgtacgaccgtacgacgacgtacgtagtaagtagtaggtacgtacgttagtttaattagttacgtaactaaactaaattaattaattaacttacgttacggtacggtacggttaccggtaaccggtaaacggtaaacggtaacggtacggtaagtacgtaacgtaacgtaacgtaacgtacgtacggtacgtacgtacg

SEQ ID NO: 430360 - DNA, 675 bp, Homo sapiens
  misc_feature: GZ8MTXP02JNCVE.19.71.G05.1.454.CMB.2.raw
  modified_base (239)..(239): a, c, t, g, unknown or other
  modified_base (250)..(250): a, c, t, g, unknown or other
  modified_base (314)..(314): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccgatcgaactgacaagtccagccaacaatctttanacagttccaanaatagaaactctagcttggaccagcagagaccaggaccagccctctaggctgctcatttaccgnggactacgtccgtaccggacgtccgggtcctacgtaccgtattcgaggtcggacgacggtcggggtcgtagggaactagttactttaccacgttcctacctaacctacgtaccgaacgtacccgtaacgtcccgtacggaccgtacgggtacgtaacggaaacggtagttaggtacggtacgtttaagttttacttaagttacgtaaactaaaacgttaaatttaactttaaagtttaacgttacgtttacggtacggttaaccggttaccggaaccggtaaacggggtaaccgtaaagggtacgtaacgtaagtacgtaaacggtaacggtaacgtggtacggtacgtacgtaacctacg

SEQ ID NO: 430361 - DNA, 626 bp, Homo sapiens
  misc_feature: GZ8MTXP02IXJEI.19.71.G05.1.454.CMB.2.raw
  modified_base (237)..(237): a, c, t, g, unknown or other
  modified_base (278)..(278): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactacttagcttggtaccaagnagacacgagacacgcctacgtagctcgcctactagtttacgtcggactacgtacccggtaacccgggacgttccccggggtacccctacgaccgtctacgaggtcggcgcggggtcgggtacgtagggactagtacttacacttccacaccatcgaagccagcctagacgaggtctagtaaagtcgttggtcgtattaagtttatttagtacgtaactaaactatttaaatttagttaacttacgttcgggttaacgtccggttaacgggaccgtaaaacgggtaaccgtagggtacgtaattaacgaacgaaacggaaaccgttacgtggtacggtactaccgaacc

SEQ ID NO: 430362 - DNA, 597 bp, Homo sapiens
  misc_feature: GZ8MTXP02IMOI4.19.71.G05.1.454.CMB.2.raw
  modified_base (114)..(114): a, c, t, g, unknown or other
  modified_base (243)..(243): a, c, t, g, unknown or other
  modified_base (259)..(259): a, c, t, g, unknown or other
  modified_base (265)..(265): a, c, t, g, unknown or other
  modified_base (315)..(315): a, c, t, g, unknown or other
  modified_base (408)..(408): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttcnctgttgctctggatctctggtgcccacggggacatcgtgatgacccagtctccagactccctggctgtgtctctggggcgagccgggcctacgatcgaactgactaagtccagccacaattcttttaanactataccaataatanaaactntagcttagacagacagacacagacagcctcgagctcgactactattacgnggactacgtaccgtaaccggtacgtccgggtacctagaccgtatcgaggtcgacgtacggtcggggtcacgggactagtcttcacttcacacnctacacgacgacgctcgacgacgtacgtagtaagtagtagtcgtacgttagttattattagtactaactaattaattaacttacttacgttacgtacggtacggttacggtacggtaacggtaacggtaacggtacgtaacgtaacgtacgtaacgtaacgtaacgtacgtacgtacgtacgtactacg

SEQ ID NO: 430363 - DNA, 579 bp, Homo sapiens
  misc_feature: GZ8MTXP02GZGFP.19.71.G05.1.454.CMB.2.raw
  modified_base (251)..(251): a, c, t, g, unknown or other
  modified_base (332)..(332): a, c, t, g, unknown or other
  modified_base (407)..(407): a, c, t, g, unknown or other
  modified_base (461)..(461): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgaggccgggccaccgatacaactgacaagtccagccactaattcttttanactagttaccaaacaatagaaaactacttagcttggaccagcagagaccaaggacagccctctaggctgctctatttacgnggcagtaccgtaaccccggggtaatccccccgggggtccctaggacccgtattacgagtcgggcagggcggttcnggggaactagtactttcactctacaccatcacgcacgcctgccaggctagaaangtgtgcttaagtttataattcgacaaataattattaagttaataccgttcgtaggtaccgttcggaaccgaaaggaccgtaaaggtgaaataatacgaagacgaatcggtacgcgtcg

SEQ ID NO: 430364 - DNA, 573 bp, Homo sapiens
  misc_feature: GZ8MTXP02FNFNP.19.71.G05.1.454.CMB.2.raw
  modified_base (425)..(425): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatctccggggacagagtcgctagcgacagtgttgcttggcacgtgggtcaggcagtccccatcgagaggtctagagtggctaggggaaggacagtatttcaattgtccaaacacggtaggaaattaacaaagtttatgaccacctattctgttagagtagtccgactagacaaatacaaacggtanaaacacataccgaaagaacccagttccacccgtgacaggtctacgacccttacgtgtacgaccgtacccggaaggacccgtaggggtacgttaacttaagttaccgtaggtacgggaaacggtaacccggtccccctaagtaaaccgg

SEQ ID NO: 430365 - DNA, 530 bp, Homo sapiens
  misc_feature: GZ8MTXP02JCQI2.19.71.G05.1.454.CMB.2.raw
  modified_base (342)..(342): a, c, t, g, unknown or other
  modified_base (454)..(454): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtggtcaggccagtccccatccgagaggtctagagtggctggggaaggacagtatttcatgtccaacacgtggaactacaaattntagcaccatctgttagagagtcgactgacaatacaacgtagacacatacgaaagaacctagttcctacctgacacgctcgacctctgtcgaccgtcccgaggacgacgggtntagtattacgtggtaggacgtacggaccccagtacgacactacgcctaccgtcgtcgtcgtcggtcgtacgttaag

SEQ ID NO: 430366 - DNA, 568 bp, Homo sapiens
  misc_feature: GZ8MTXP02I73KO.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctagagtggctggggaagacattatttcattcgtccaaacgacggtaggaaattacaaaattatgacacctatctgttagagtagtcgatgaacaatacgaaacgtagaacacaatacgaaagaaacccagttcctaccgtgacagtctacgaccctcgtgtacgaccgtacccggaacggtaccgtacggggttagttaacttaacgtttacgtaggttacggggaaacggtaccggacccccgtaagtaaaccgg

SEQ ID NO: 430367 - DNA, 613 bp, Homo sapiens
  misc_feature: GZ8MTXP02FWYHB.19.71.G05.1.454.CMB.2.raw
  modified_base (235)..(235): a, c, t, g, unknown or other
  modified_base (243)..(243): a, c, t, g, unknown or other
  modified_base (247)..(247): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtcagcacaatctttanacatacanatanaactatagctgacagcagacgacagacacgcctacgtagctgctactacttacgtcggactacgtaccgtaccggtacgtccgggtccgtaccgtacgtacgtacgtacggtcggacgacggtcgggtcggtacgggtacgtacgtacttactacctacctacctaacctactacgacgacgacgaccgtcgacgtacgacgtacgaagtagtggtagtacgttagtttagttagttacgtaacgtaaactaattaatttaacttattacgttacgttacggtacgtacggtacggtaacggtaacggtaacggtacgtacgtacgtacgaacgtacgtaacgtacgtacgtacgtacgacgtacg

SEQ ID NO: 430368 - DNA, 595 bp, Homo sapiens
  misc_feature: GZ8MTXP02IQX53.19.71.G05.1.454.CMB.2.raw
  modified_base (242)..(242): a, c, t, g, unknown or other
  modified_base (322)..(322): a, c, t, g, unknown or other
  modified_base (367)..(367): a, c, t, g, unknown or other
  modified_base (389)..(389): a, c, t, g, unknown or other
  modified_base (439)..(439): a, c, t, g, unknown or other
  modified_base (467)..(467): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggcgggccaccgatcaactgacaagtccagccactaattctttanacagttaccaacaatacgaaaacttctagcttagaccagacagacgaccaggacagcctcgtaggcctgctctattacgngggactatccgtaacccggggagtcccggggtccctaggaccctnttcgaggtggacaggcggggtntagggacagtacttcacttcacacatcagcacgcctgacgaagctagaanagtggtcggtattaagtttattacgttntaacaaattaaattattaattagttacgttcggtacggttaccgttacggaacgtaaacgggaaccgaaaggttagaacttaagtacgaacggtaaccgtaaacgtggtacggacctacggacctacg

SEQ ID NO: 430369 - DNA, 595 bp, Homo sapiens
  misc_feature: GZ8MTXP02JPKO5.19.71.G05.1.454.CMB.2.raw
  modified_base (242)..(242): a, c, t, g, unknown or other
  modified_base (253)..(253): a, c, t, g, unknown or other
  modified_base (258)..(258): a, c, t, g, unknown or other
  modified_base (317)..(317): a, c, t, g, unknown or other
tcagtactctcgtgcacgaccggtgctcgatttagtgtcgtcgcaagagagaggggtgaggtacaacaggcaggcaggggcagcaagatggtgttgcagaccaggtcttcatttctctgttgctctggatctctggtgcccacggggacatcgtgatgacccagtctccagactccctggctgtgtctctgggcgagcgggccacgatacgaactgactaagtccagccacaatcttttaanacacgtacaanaatanaaactatagctacgacagcagacgaccaggacacgcctcgaggctgctactatttacgnggactactaccgtaaccgggtacgtccccggggtcctacggacctattcgaggtcggcgtacgggtcgggtcgtagggactagtactttcactctacacatcgacgacacgcgtcgcgacgacgtagagagtgtagtacgttacgtttattagttagtactaactaaacttaattaattaattacgttacgttacggtacggttacggtacggtaaacggtaacgtaacggtaggtacgtaacgtacgtacgtacgtaacgtacggtacgtacgtacg

SEQ ID NO: 430370 - DNA, 574 bp, Homo sapiens
  misc_feature: GZ8MTXP02GCKE5.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgctcacctgtcgccatccgtccggggacaggagtcgctagcgacagtgttgcttggcacgtgggtcaggcacgtccccatcgagaggtctagagtggcgtaggggaagacatatttcattcgtccaaactacggtaggaaactaacgtaaaatttatacgacctaaccctaattccttaggttagaagtacgtcgaactgaacaatacaaacgtagaacactagtacgaaacgtaacctacgttcctacctgacagcctacgacctcgtcgtacgaccgtcccggagaccgtacggggtattactaacgttacgtaggtacggaacgtaccggacccctaagtaacg

SEQ ID NO: 430371 - DNA, 640 bp, Homo sapiens
  misc_feature: GZ8MTXP02JO2CJ.19.71.G05.1.454.CMB.2.raw
  modified_base (229)..(229): a, c, t, g, unknown or other
  modified_base (239)..(239): a, c, t, g, unknown or other
  modified_base (250)..(250): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccanaatcttttanacagttccaanatagaaactctagcttaggaccagcagacgaccaaggacacgtcctacctacgtctcgtctactactttacgtacggtacgtacgtaccgtacccggtaaccggtccggtcccccgtcgtaccgtacgtacgtacgtcggcgcggtcgggtcgtacggacgtagtacgttactactacctacctaacctactacgacgacgacgccgtacgacgacgtacgtacgaacgtagtaggtacggtacgtagtttatttagttacgtacgtaaactaaacttaacttaacttaacttacgttacgtacggtacggtacggtaccgtaaacggtaacgtaacgtacgtaacgtaacgtaacgaacgtaacgtacgtacgtacgtacgtacgtacg

SEQ ID NO: 430372 - DNA, 573 bp, Homo sapiens
  misc_feature: GZ8MTXP02GSE21.19.71.G05.1.454.CMB.2.raw
  modified_base (235)..(235): a, c, t, g, unknown or other
  modified_base (246)..(246): a, c, t, g, unknown or other
  modified_base (301)..(301): a, c, t, g, unknown or other
  modified_base (308)..(308): a, c, t, g, unknown or other
  modified_base (348)..(348): a, c, t, g, unknown or other
  modified_base (358)..(358): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccacaatctttanacagttccaanaatagaaaactcttagcttggtaccagcagagaccagacagcctctaggctgctnatttcgngcagtcgaccggatccggtccacgacgtatcgagtcgacngggcggtcgnggactagtacttcactctacacatacgacgcacgctcgacgacgactagaagtagtgtcgtattaagtttattagttacgtaactaaattaattaagtttacttacgttacgttcggtacggttaccgttacggaacgtaaacgggtaaccgtaaggtacgtaacgttacgtacgtaacgtaacgtaacgttcggtacggtactacgtacctacg

SEQ ID NO: 430373 - DNA, 592 bp, Homo sapiens
  misc_feature: GZ8MTXP02GYG3K.19.71.G05.1.454.CMB.2.raw
  modified_base (239)..(239): a, c, t, g, unknown or other
  modified_base (314)..(314): a, c, t, g, unknown or other
  modified_base (364)..(364): a, c, t, g, unknown or other
  modified_base (379)..(379): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggaccaccatcaactgcaagtccagccacaattcttttanacagttccaacaatagaaaactacttagcttggtaccagcagagaccagacagcctctaggctgctcatttacgnggcatccgtacccgggaatccggggtccccctgaccgattcaggtcggcnggcgggtctgggacngtatttcactctcaccatcagcagcctgcagggctagaaagtactggtacgacgtagttttattagttagtactaaaactaaatttaatttaattaagttacgtttacggtacggtaccgttcggtaaccgtaaacggggtaacccgtaaagggtacggtaattaacgtccgaaagtaaccggtaaacgttcggtagggtaccttcggaaccc

SEQ ID NO: 430374 - DNA, 524 bp, Homo sapiens
  misc_feature: GZ8MTXP02JF6GK.19.71.G05.1.454.CMB.2.raw
  modified_base (239)..(239): a, c, t, g, unknown or other
  modified_base (313)..(313): a, c, t, g, unknown or other
  modified_base (364)..(364): a, c, t, g, unknown or other
  modified_base (420)..(420): a, c, t, g, unknown or other
  modified_base (424)..(424): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaacaatagaaaactactagcttggtaccagcagagaccaggacagcctctaggctgctcatttacngggcactcgtacccgggaatccggggtccccctgaccgattcgagtcggcnggcgggtctggggacagtatttcactctcaccatcagcagcctgcaggctgaaagntggnggtctagtttattattgtacaaataattattattatacttcgtggtacgttcggaccaaagggacctaggtacgatatcgagacgacgtgtcggctagac

SEQ ID NO: 430375 - DNA, 590 bp, Homo sapiens
  misc_feature: GZ8MTXP02GSGPI.19.71.G05.1.454.CMB.2.raw
  modified_base (238)..(238): a, c, t, g, unknown or other
  modified_base (246)..(246): a, c, t, g, unknown or other
  modified_base (255)..(255): a, c, t, g, unknown or other
  modified_base (259)..(259): a, c, t, g, unknown or other
  modified_base (268)..(268): a, c, t, g, unknown or other
  modified_base (303)..(303): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggccggggcctacggactacggacgtcgactaagtcagcanatctttanacatacaanatanaactactanctagtacagacagacgacgagacacgctcgacgcngctctattacgtcggctactacgtaccggtacgtccggtccccgtacgacgtactacgacgcgcgcgcgggtcggtaggacgtagtacttactactactacacactacgacgcgacgcctcgacgacgcgtacgagtagtgtagtagtagttattagtacgtactaataattaattaagttacgttacgttacgtacggtacgttacggtacggtaacggtaacggtaacggtacgtaagtacgtaacgtaacgtaacggtaacgtacggtacggtacgtacgtacg

SEQ ID NO: 430376 - DNA, 691 bp, Homo sapiens
  misc_feature: GZ8MTXP02H9RKJ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaagccctgcacgacccctctcgctcacctgtcgccatccgtccggggacagagtcgctagcgacagtgtgcgttggcacgtggtcaggcacgtccccagtcggaggtaggtctaaggaggtgggcgtaggggaaacggactaagttacgttttacaacgttcgtacccaaacgtaacggtaagggtaaaacttaaacgtaaaatttatacgaaccctactacttacgttaggttaggaaggtacgttccgaaacttacggaaacctaaacgttaaccgaaaaccgggttaacgaaaccctaaacgtaaacgttaaacccggaaaacggttaaaccccttaacggtttccccctaacccgttacggacctaacggacctttaccggtaacccttcgtacggttaccggaacccgttacccggaaggtaccgtacggggtttatacgtttaagtacgtaggtacggtaaaacgcccgtacccaaagtacg

SEQ ID NO: 430377 - DNA, 588 bp, Homo sapiens
  misc_feature: GZ8MTXP02J1NGR.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatctccggggacagagtcgctagcgacagtgttgcttggcacgtgggtcaggcacgtccccatcgagaggtctagacgtggctaggggaaggcagttattcgattgtcccaaagacggtaggaaataactaaattatcgacaacctatcttgttgaagtacgtcgactagaacaatcgaaacgtagacacatacgaaagaaccctagttccctacctggacacgtcgtacgacccttcgtacggtacgacccgttacccggaacggtaccgtacgggggttacttaagttaacgtttacggtacgggttacggaaacggtaccccgggaccccctaaagttaacccgg

SEQ ID NO: 430378 - DNA, 775 bp, Homo sapiens
  misc_feature: GZ8MTXP02HR8X3.19.71.G05.1.454.CMB.2.raw
  modified_base (244)..(244): a, c, t, g, unknown or other
  modified_base (258)..(258): a, c, t, g, unknown or other
  modified_base (331)..(331): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagccgggccaccatcaactgacaagtccagccaacaattctttaanactacttaccaaanaatagaaaactactagcttaggaccagacaagacgaccaggacacgcctaccgaggctgctactaatttacgnggactacgtccggtaacccgggtaacgtcccccggggtccctagacccgtattcggaggtcgggcgtacgggtccggggttacgtacggggaacctaggttaccttttacccgaaccttacccgtaccctaaaccctacgtacccgaacgtacccgtaaccggtacccgtacggaacccggtacgggtaccgttaaagggaaacggttacggttacgggttacggtacgtttaaaggtttttaaagtttaacgtttaacggtaaacctaaaacgttaaaatttaaacttttaaagtttaaacgtttaaccgtttacgggttacgggttaacccggtttaccggggtaaacccggtaaaacggggtaaacccgtaaaaggggttacggtaaacttaacggtaaccgaaaacggtaaaccgtaaacggttcggtacggtacgtacg

SEQ ID NO: 430379 - DNA, 505 bp, Homo sapiens
  misc_feature: GZ8MTXP02IF6NR.19.71.G05.1.454.CMB.2.raw
  modified_base (233)..(233): a, c, t, g, unknown or other
  modified_base (299)..(299): a, c, t, g, unknown or other
  modified_base (305)..(305): a, c, t, g, unknown or other
  modified_base (406)..(406): a, c, t, g, unknown or other
  modified_base (479)..(479): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacatctttanacagttccaacaatgaaaactcttagcttggtaccagcagagaccaggacagcctctaggctgctnattacngggcatctaccgggatccggggtcctgaccgatcagtgcagcgggtctgggacagatttcactctcaccatcagcagcctgcaggctagagatggtaggtnttagtttatatatactaatattattacttatacgttacgtagtacgttcggacgtaaggacgtaggtcgatanacgaagacgagtcgagctacgactac

SEQ ID NO: 430380 - DNA, 552 bp, Homo sapiens
  misc_feature: GZ8MTXP02H4RI8.19.71.G05.1.454.CMB.2.raw
  modified_base (370)..(370): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtgccactcgtccggggacaggagtcgctagcgacagtgttgcttggcacgtgggtcaggcagtccccagtcgagaggtctagagtggcgtaggggaacgacatatttcatgtaccacacgtaggaatacaaattangacacctatctgttagagagtcgactagacaaatacaacgtagaacacaagtacgaaacgaacctacgttacctcccgtagcacgtacctgaacccttcgtcggtacgtaccgtccggacggacgtaccgggttagtacgttacgttaacgtagtacggaacgacggaccccgatacgaacg

SEQ ID NO: 430381 - DNA, 561 bp, Homo sapiens
  misc_feature: GZ8MTXP02I900O.19.71.G05.1.454.CMB.2.raw
  modified_base (229)..(229): a, c, t, g, unknown or other
  modified_base (238)..(238): a, c, t, g, unknown or other
  modified_base (313)..(313): a, c, t, g, unknown or other
  modified_base (371)..(371): a, c, t, g, unknown or other
  modified_base (433)..(433): a, c, t, g, unknown or other
  modified_base (437)..(437): a, c, t, g, unknown or other
  modified_base (450)..(450): a, c, t, g, unknown or other
  modified_base (532)..(532): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccanaatctttanacagttccaacaatgaaaactctagcttggaccagcagagaccaggacacgcctccaggctgctctaatttacgngggacagtccgtaaccccgggaagtcccggggtccccctgaccgtatttcagtcggcnggcgggtctggggacagtactttcactctcacccatcagtcagccctgcgaggctagaaagntggnggtctaaggtttnttagtgtacctaaataattattaattacgtacttcgtacggtacgttcggacgtaaacggggtacctaagggtacgattaanaacgaagtaacgtacgtgcggactacgac

SEQ ID NO: 430382 - DNA, 591 bp, Homo sapiens
  misc_feature: GZ8MTXP02IS9KJ.19.71.G05.1.454.CMB.2.raw
  modified_base (230)..(230): a, c, t, g, unknown or other
  modified_base (238)..(238): a, c, t, g, unknown or other
  modified_base (247)..(247): a, c, t, g, unknown or other
  modified_base (251)..(251): a, c, t, g, unknown or other
  modified_base (259)..(259): a, c, t, g, unknown or other
  modified_base (265)..(266): a, c, t, g, unknown or other
  modified_base (270)..(270): a, c, t, g, unknown or other
  modified_base (277)..(277): a, c, t, g, unknown or other
  modified_base (287)..(287): a, c, t, g, unknown or other
  modified_base (299)..(299): a, c, t, g, unknown or other
  modified_base (361)..(361): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctctggggcgaggcgggccacgatacgaactgacaagtccagccanatctttanacatacaanatanaaatatantgacannaganacagacngcctcagctnctatatttacgnggactacgtccgtacccggggacgtcccggggtaccccctacgaccgtattcgaggtcggcnggggtcggtcgtgggactagtactttaccactctacaccatacacgacacgcctgcgaggtctaggaagtagtggtaggtacttagtttattagttacgtactaataatttaattagtttaacttacgtttacggttacggtaccggttacggaaccggtaaacgggtaaccgtaagggtacgtaatacgtaacgaacggtaacgtaacgtggtacggtacgtacgaccg

SEQ ID NO: 430383 - DNA, 552 bp, Homo sapiens
  misc_feature: GZ8MTXP02I4SPC.19.71.G05.1.454.CMB.2.raw
  modified_base (441)..(441): a, c, t, g, unknown or other
  modified_base (473)..(473): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatccgtccggggacagagtcgctagcgacagtgttgcttggcacgtgggtcaggcacgtccccagtcgagaggtctaggagtggcgtggggaacgactattatttcatcgtaccacgacgtaggaaatacgaaaattatacgaccaaccatcgttagttagaaagtcgactagaactaatacaaacgtacgaacacatacgaaanaacctagttacctccgtgacagctacgacctntacgtcgacctacccggaggacgtacggggtataactagttacgtggtacggaacgtaccggaccccagtacgactacg

SEQ ID NO: 430384 - DNA, 545 bp, Homo sapiens
  misc_feature: GZ8MTXP02F2HSS.19.71.G05.1.454.CMB.2.raw
  modified_base (237)..(237): a, c, t, g, unknown or other
  modified_base (313)..(313): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttcccaaacaatagaaaactactagcttaggaccagcagagaccaggacagcctctaggctgctcatttacnggcatcgtacccgggatcccccggggtcctgaccgtattcgagtggcaggcgggtctgggacagtatttcactctcacatcagcacgcctgcgaggctaggaagagtgtgtactagtttattatgtactaaactaattattattattacgttcgtaggtacgttacggaccgaaagggtaccgtaaagggtgtaagtaacgtacgaaggtacgtaacgtcggtagacgtacg

SEQ ID NO: 430385 - DNA, 721 bp, Homo sapiens
  misc_feature: GZ8MTXP02JP203.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcctccggggacagagtcgctagcgacagtgttgcttggcacgtgggtcaggcacgtccccatcgagaggtctagagtggctggggaaggacattatttcatgtaccaaacacggtaggaaactacgaaaatttatacgacaaccctattccgttagggttaggaaacggtacgttaccgggaacctttagggaaaccctaaagttacccgtaaaaccggttaacggaaaccgaaacctaaacgttaaccggaaaaccgtaaaaccccgtaacggtttaccctacccccgttagaaccgtacggtaccgtacggtaaccccttcgttacggtacgtaacccgttacccgggaacgggtaaccgtacgggggttacttaaagttacgttaaccgttagggttacgggaaacggtaccgggacccccctaagttaaccggaacctacgttaccggaaccctaacccgttaccgtaccgttaccgtcggttaccgaccgtttaaacgg

SEQ ID NO: 430386 - DNA, 541 bp, Homo sapiens
  misc_feature: GZ8MTXP02IHKLD.19.71.G05.1.454.CMB.2.raw
  modified_base (238)..(238): a, c, t, g, unknown or other
  modified_base (358)..(358): a, c, t, g, unknown or other
  modified_base (374)..(374): a, c, t, g, unknown or other
  modified_base (384)..(384): a, c, t, g, unknown or other
  modified_base (418)..(418): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanacagttccaaacaatgaaaactacttagcttaggtaccagcagagaccaggacagcctctaggctgctcatttactggcatctacccggaatccggggtcccctgaccgattcagtggcnggcggtctggggaccngatttcactntcaccatcagcagcctgcagctagaagatgtggntagtttatatgtcaaatatattattaatacgtttcgtaggtacgtttcggacctaaagggaaccgtaaggtacggtaataggtaaccaaggtaaccgaaacgtggttaggcctttaaggaccc

SEQ ID NO: 430387 - DNA, 546 bp, Homo sapiens
  misc_feature: GZ8MTXP02GRNZ4.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggcgtaggggaagactagttatttcattcgtccaaacgacgtaggaaataacaaattatagacaccatctgttagagtagtcgactgaacatacaaacgtagaacacatacgaacgaacctacgttcctaccgtgacagactacgacctcgtacgtcgaccgtccggacggaccgtacgggtattagtaacgttacgtaggtacggaacgtaccgaccccgaagtaacg

SEQ ID NO: 430388 - DNA, 517 bp, Homo sapiens
  misc_feature: GZ8MTXP02IGHPJ.19.71.G05.1.454.CMB.2.raw
  modified_base (234)..(234): a, c, t, g, unknown or other
  modified_base (238)..(238): a, c, t, g, unknown or other
  modified_base (242)..(242): a, c, t, g, unknown or other
  modified_base (251)..(251): a, c, t, g, unknown or other
  modified_base (255)..(255): a, c, t, g, unknown or other
  modified_base (264)..(264): a, c, t, g, unknown or other
  modified_base (275)..(275): a, c, t, g, unknown or other
  modified_base (290)..(290): a, c, t, g, unknown or other
  modified_base (292)..(292): a, c, t, g, unknown or other
  modified_base (298)..(299): a, c, t, g, unknown or other
  modified_base (343)..(343): a, c, t, g, unknown or other
  modified_base (345)..(345): a, c, t, g, unknown or other
  modified_base (349)..(349): a, c, t, g, unknown or other
  modified_base (356)..(356): a, c, t, g, unknown or other
  modified_base (362)..(362): a, c, t, g, unknown or other
  modified_base (383)..(383): a, c, t, g, unknown or other
  modified_base (385)..(385): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacggactaacggacgcgactaagcagcanattnttanacatacaanatanaactactanactgtacaganagacgacgagacacncncacgcnnctctactagtgcactacgacgtacgtcggtcccgcgacgactcngngcgngcgtcgngacatntctctctcacacacacacacncncacgacgacgagagagtgtgtagtagttatatactataatatattattatacgtacgtacgtacgtacgtacgtaacggtaacgtacgtacgtagtagtaacgacgacgtacgtacgtacgtacgtacgacg

SEQ ID NO: 430389 - DNA, 509 bp, Homo sapiens
  misc_feature: GZ8MTXP02FMO9R.19.71.G05.1.454.CMB.2.raw
  modified_base (367)..(367): a, c, t, g, unknown or other
  modified_base (423)..(423): a, c, t, g, unknown or other
  modified_base (428)..(428): a, c, t, g, unknown or other
  modified_base (444)..(444): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaacaattctttatacagttccaaacaatagaaaactacttagcttggtaccagcagagaccaggacagcctcctaggctgctcatttactgggcatccgtacccggggaactccggggtccccctgaccgattcagtggcngcgggtctggggacagtatttcactctcaccatcagcacgcctgcaggctgaaganggtgntagtttatatgacaanattattatatatcgtgacgttcgacaaggacaaggtgatatcgagacgaacgtgacggctagacc

SEQ ID NO: 430390 - DNA, 525 bp, Homo sapiens
  misc_feature: GZ8MTXP02IB4UQ.19.71.G05.1.454.CMB.2.raw
  modified_base (221)..(221): a, c, t, g, unknown or other
  modified_base (303)..(303): a, c, t, g, unknown or other
  modified_base (341)..(341): a, c, t, g, unknown or other
  modified_base (360)..(360): a, c, t, g, unknown or other
  modified_base (369)..(369): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctntcgctcacctgtgccatctccggggacagagtcgctagcgacagtgttgcttggcacgtgggtcaggcagtccccatcgagngtctagagtggctgggaacgacatattcatcgtaccanacgtagaaatacaaattangacacctanctgtagagagtacgactgaacaatacaacgtagaacacaattacgaaacaacacgttcaccctgacagctacgacctctagtacgacctccggacggacgtacggggtcttaagtattaacgtaggtacggaacgaccggacccctaatacgaacg

SEQ ID NO: 430391 - DNA, 727 bp, Homo sapiens
  misc_feature: GZ8MTXP02H8L4V.19.71.G05.1.454.CMB.2.raw
  modified_base (239)..(239): a, c, t, g, unknown or other
  modified_base (322)..(322): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctcagactccctggctgtgtctcgtgggcgagcgggccacgatcgaactgacaagtccagccataatcttttanacagttaccaaacaatagaaactactagcttaggtaccagcaagacgaccgaggacagcctacgtaggctgctcatttacggnggacacgtaccgtaccggtacgtccggtccccacgtaccgtacgtcgaggtcggacgtcgggtccgggttacgtacgggtactacggttactttaccgaccttaccgtaccaaccgtacgtaccgaaccgtaccgtaccggtccgtacggacggtacggtacgtaaggtaaacgttacgttacggtaacggttacgtttaaagttttaagtttacgttaacgtaaactaaacgtttaaagtttaaactttaacgttaacgtttaacgtttacgggttaacgggttaccggtttaaccgggaaaccgttaaaacggggtaccggttaaaacgggtacggttaacgttaacggtaaccgtaaacggtaaacggttacggttacggtacggtaccgtaacgtaacccg

SEQ ID NO: 430392 - DNA, 604 bp, Homo sapiens
  misc_feature: GZ8MTXP02IQA89.19.71.G05.1.454.CMB.2.raw
  modified_base (317)..(317): a, c, t, g, unknown or other
  modified_base (383)..(383): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcagacccctctcgctcacctgtcgccatcgtccggggacagagtcgctagcgacagtgttgcttggcacgtgggtcaggcacgtccccagtcgagaggtctaggngtggcgtagggaacggactagtatttcagtcgtaccacgtacgtaggaaattaacgtaaaatttanacgacaacccgtattcgttagttagagtacgtacgactagaacaagtacaaacgtagaacactaacgtacgaaacgtaacctacgttacctcccgtagccgtaagcctacgtaccctcgttcgaccgtaccgtaccccggaaaggtaacccggtacgggttattaacgtaacgtttaaccgaggtaacgggaaaccgtccggaaccccctagtaacgaacg

SEQ ID NO: 430393 - DNA, 590 bp, Homo sapiens
  misc_feature: GZ8MTXP02H1QFZ.19.71.G05.1.454.CMB.2.raw
  modified_base (228)..(228): a, c, t, g, unknown or other
  modified_base (239)..(239): a, c, t, g, unknown or other
  modified_base (250)..(250): a, c, t, g, unknown or other
  modified_base (316)..(316): a, c, t, g, unknown or other
  modified_base (371)..(371): a, c, t, g, unknown or other
  modified_base (419)..(419): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggccacgatcaactgacaagtccagccanaatcttttaanacactaccaanaatagaaactactagtctacgtacagacagacgacagacacgtcctcgagctgctactatttacgnggacagtaccgtaaccgggaacgtccgggtcccctagaccgtatcgagtcggacngggtcgggtcagggacagtactttcactcctacactatcacgcacgcncgacgacgacgtagaagtagtagtaggtagttagttagttagttagtaactaaactaaattaattaattattacgttacgttacggtacggttacggtacgtaacggtaacggtaacggtacggtaagtacgtaacgtaacgaacgtacgtacgtacggtacgtacgtacg

SEQ ID NO: 430394 - DNA, 641 bp, Homo sapiens
  misc_feature: GZ8MTXP02I5NXN.19.71.G05.1.454.CMB.2.raw
  modified_base (226)..(226): a, c, t, g, unknown or other
  modified_base (236)..(236): a, c, t, g, unknown or other
  modified_base (244)..(244): a, c, t, g, unknown or other
  modified_base (248)..(248): a, c, t, g, unknown or other
  modified_base (258)..(258): a, c, t, g, unknown or other
  modified_base (270)..(270): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacatcaactgcaagtccagccanaatcttttanacatcaanatanaaactactanctgacagcaganacagacagcctcagctgctctatttacgtggactacgtaccgtacccgggacgtcccggggtccccctacgaccgtattccgaggtcggcgagggtccgggtcgtacggggactagtactttacactcctacaccatcacgcacgtcctgacgacggctaaggaaagtagtggtcggtacttaaggtttttaactttaagtttacgtaactaaaacttaaaatttaatttaaagtttaaatttacgtttacggttaacgggttaaccggtttaccgggtaacccggtaaacgggggtaaaccgtaaaggggttacggtaacttaacgtaacgaacggtaacggtaacgttacggtacggtacgtacgtacg

SEQ ID NO: 430395 - DNA, 647 bp, Homo sapiens
  misc_feature: GZ8MTXP02IA6SA.19.71.G05.1.454.CMB.2.raw
  modified_base (245)..(245): a, c, t, g, unknown or other
  modified_base (256)..(256): a, c, t, g, unknown or other
  modified_base (261)..(261): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcctggctgtgtctcgtgggcgagcgggccacgatacgaactgacaagtcagcactaattctttaanactactacaanaatanaaactctagctacgacagacagacgacagacacgtcctacgacgctcgctacgtactttacgcggactacgtaccgtaacccggggacgttcccgggtcccctacgtaccgtatcggaggtcggacgtcggggtccgggtacgtacgggactagttactttaccaccttacctaccactactacgacgaccgacgtccgtacgacgtaggtacgtaaggaagtcgtggtacggttatttaagttttattacgttacgtaactaaattaaatttaacgtttattaacgtttacgttacggtacggttaccgttaacggaacggtaaacgggtaacgtaaggtacgtaactacgtaacgaacgaacgtacgtacggcgtactacgacc

SEQ ID NO: 430396 - DNA, 532 bp, Homo sapiens
  misc_feature: GZ8MTXP02GAMK8.19.71.G05.1.454.CMB.2.raw
  modified_base (239)..(239): a, c, t, g, unknown or other
  modified_base (315)..(315): a, c, t, g, unknown or other
  modified_base (342)..(342): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgacaagtccagccacaatctttaanacagttccaaacaatgaaaactactagcttaggtaccagcagagaccaggacagcctcctaggctgctcattacgnggcatctaccgggatccccggggtccngacatcagtgcagcgggtctagggacagtatttcactctacacatcagcagcctggacaggctagaagtagtgtggacttaagtttatagttgtacaaataattagttaattattactttacggtaggtaacgtttcggacctaaaggggaccaaagggtgaataagtacgtagacgaatggtcgctacg

SEQ ID NO: 430397 - DNA, 666 bp, Homo sapiens
  misc_feature: GZ8MTXP02IVD25.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtgggtcaggcacgtccccagtcggagaggtctaggagtggcgtaggggaaagactattactttcagttcggtccaaacgtacggtaggaaacttaacgtaaatttagtcgacccgtactattcgtaggttaggaagtacgtaccgaacgttacgaaactaaacgttaccgaaaacggttaacgaaacaaccgtaaacgtaccggaaaacggtaaaccccttaacggtttccctaccccgtagtaccgaacgtccgtaccgtaacccttcgtacggtacccgtacccgttacccgggaaacggtaccggtaaaccggggtttattaaacgttaacgtttaacggtagggtaaacggaaccggtacccgaacccgtaagtaacg

SEQ ID NO: 430398 - DNA, 615 bp, Homo sapiens
  misc_feature: GZ8MTXP02F02C7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagtgttgcttggcacgtgggtcaggccacgtccccagtcgagaggtctagagtggcgtaggggaaggacattatttcattcgtaccaacacgtaggaaactaactaaaattatgacacctatctagttgagagtcgaactgaaacaagtacaaaacgtagacaactagtacgaaaacgaaacctaacgttcctacccgtagaccacggtacctacgaaccccttcgtacggttaccgaacccgttccccggaaagggtaccgttaaaccgggggtttacttaaacgttaacgtttaacggtacgggtaacggggaaccggtacccggtaaccccgtaacgtaacg

SEQ ID NO: 430399 - DNA, 541 bp, Homo sapiens
  misc_feature: GZ8MTXP02FO450.19.71.G05.1.454.CMB.2.raw
  modified_base (236)..(236): a, c, t, g, unknown or other
  modified_base (310)..(310): a, c, t, g, unknown or other
  modified_base (362)..(362): a, c, t, g, unknown or other
  modified_base (400)..(400): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgcaagtccagccacaattcttttanacagttccaacaatgaaaactacttagcttggaccagcagagaccaggacagcctcctaggctgctcatttacngggcatccgtacccggggaatccggggtccccctgaccgattccgagtggcnggccggggtctggggaccagtatttcacttctccaccntcagcacgctgcaggctagaagatgtggactagtttattattagtactaaataattattattaatacttcgtggtaacgttcggactaaaggggacctaaggtcggtatagtaacgacgtaacgaacgtgtacggctgacc

SEQ ID NO: 430400 - DNA, 608 bp, Homo sapiens
  misc_feature: GZ8MTXP02GAHU5.19.71.G05.1.454.CMB.2.raw
  modified_base (245)..(245): a, c, t, g, unknown or other
  modified_base (258)..(258): a, c, t, g, unknown or other
  modified_base (263)..(263): a, c, t, g, unknown or other
  modified_base (324)..(324): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcgaactgacaagtccagccacaattctttaanactacgtaccaanaatanaaactactagtctgacagcagacgaccagacacgtcctacgtagctgctatacgtttacgnggactacgtaccgtaaccgggtacgttcccggggtcccctagaccgtatcgaggtcggcgcgggtcgggtcgtagggactagttactttcactcctacaccatacgacgcacgcctgacgacggactagaagtgtggtacgtattaagtttattagttacgtaactaaattaaatttaatttacgttaattacgttacggttacggtaccgttacggaaccggtaaaggacgtaaggtacgtaatacgtaacgaacgtaacgtacgtgtacggtcgtacgtacg

SEQ ID NO: 430401 - DNA, 598 bp, Homo sapiens
  misc_feature: GZ8MTXP02F64U1.19.71.G05.1.454.CMB.2.raw
  modified_base (237)..(237): a, c, t, g, unknown or other
  modified_base (245)..(245): a, c, t, g, unknown or other
  modified_base (247)..(247): a, c, t, g, unknown or other
  modified_base (249)..(249): a, c, t, g, unknown or other
  modified_base (254)..(254): a, c, t, g, unknown or other
  modified_base (257)..(257): a, c, t, g, unknown or other
  modified_base (264)..(265): a, c, t, g, unknown or other
  modified_base (300)..(300): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagcacatctttanacatcaanananaactntanctgacannagacgacagacacgcctcagctgctctatttacgnggactacgtaccgtaccggaacgtccgggtcccctagaccgtatcgaggtcgacgcgggtcgggtacgtaggactagtactttccacttcctacacctagtacgacgacgacgtccgtcgacgacgacgtagaagtagtaggtacggtacgttagtttagttagttacgtactaactaattaattaatttacgttacgttacgttacggttacggttacggtaccggtaacggtaacggtaacggtacggtaacgtacgtaacgtaacgtaacgtacgtacgtacgtacgtacgtacg

SEQ ID NO: 430402 - DNA, 586 bp, Homo sapiens
  misc_feature: GZ8MTXP02GBF22.19.71.G05.1.454.CMB.2.raw
  modified_base (241)..(241): a, c, t, g, unknown or other
  modified_base (252)..(252): a, c, t, g, unknown or other
  modified_base (257)..(257): a, c, t, g, unknown or other
  modified_base (321)..(321): a, c, t, g, unknown or other
  modified_base (382)..(382): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgaggccggccaccatcaactgcaagtccagccacaattctttaanactataccaanaatanaaactactagcttaggaccagcagacgaccaggacacgtcctacgaggctgctactagtttcgnggctacgtaccgtacccgggtacgtcccggggtcccctacgaccgtattcgaggtcggcgngggtccgggttcgacgggactagtactttcgacctctaccactatacgacgcacgcctgcgagacagagtgtggtcgtattagtttattatagtaactaaataatttattacttagtacgttcgtacggtacgttcggaaacggtaacgggtacaagggtacgtatacgtaacgtaacgaacgtacgtaggttacgcttacgac

SEQ ID NO: 430403 - DNA, 568 bp, Homo sapiens
  misc_feature: GZ8MTXP02FV32A.19.71.G05.1.454.CMB.2.raw
  modified_base (237)..(237): a, c, t, g, unknown or other
  modified_base (314)..(314): a, c, t, g, unknown or other
  modified_base (348)..(348): a, c, t, g, unknown or other
  modified_base (358)..(358): a, c, t, g, unknown or other
  modified_base (366)..(366): a, c, t, g, unknown or other
  modified_base (388)..(388): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacttcctggctgtgtctctgggcgagcgggccaccatcaactgcaagtccagccacaatctttanacagttccaaacaatgaaaactacttagcttggtaccagcagagaccaggacagcctcctaggctgctcatttacgnggcatccgtaccggacgtccggtcccctgacctntcgagtgcgnggcgggtnggacagtattcactcacactancagcacgcctgaccgaggctagaaagtgtggtcgtacttaagttttattattagtaactaaattaaatttattaagttaacttacgttacggtacggtacggttacggaaccggaaacgggtaacgtaagggtacgtaattaacgaacgaacgtaacggtacgtggtacgtacgtacgac

SEQ ID NO: 430404 - DNA, 634 bp, Homo sapiens
  misc_feature: GZ8MTXP02FTRTY.19.71.G05.1.454.CMB.2.raw
  modified_base (244)..(244): a, c, t, g, unknown or other
  modified_base (254)..(254): a, c, t, g, unknown or other
  modified_base (258)..(258): a, c, t, g, unknown or other
  modified_base (264)..(264): a, c, t, g, unknown or other
  modified_base (314)..(314): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgagccgggccaccgatacgaactgactaagtccagccacaatctttaanacataccaanatanaaactntagcttgacagcagacacgagacacgcctcgagctgactactatttacgnggactacgtccgtaaccgggtacgtcccgggtacccctacgaccgtattacgaggtcggacgcggggtccgggtcgtaggggaacctagttactttaccacttacctaccaaccgtatacgacgacgtacgccgtcgacgacgacgtagaagtagtagtacgtacgttagtttagttagttacgttaactaaactaattaattaattacgttacgttacggttacggttacggttacggtaaccggtaaacggtaacggtaacggtacggtaagtaacgtaacgtaacgtaacgtacgtacggtacggtacgtacgtacg

SEQ ID NO: 430405 - DNA, 690 bp, Homo sapiens
  misc_feature: GZ8MTXP02IPOM5.19.71.G05.1.454.CMB.2.raw
  modified_base (237)..(237): a, c, t, g, unknown or other
  modified_base (313)..(313): a, c, t, g, unknown or other
  modified_base (360)..(360): a, c, t, g, unknown or other
  modified_base (374)..(374): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaaacaatagaaaactacttagcttggtaccagcagagaccaggacagcctctaggctgctcatttacnggcatcgtacccgggaatccggggtcccctgaccgtattcagtggcnggcggtctgggacngtatttcacgtctcaccatcgagcagccctgcctagggctaggaaacgtagttggtacggtacgttaaggtttttaatttaacttacggttaaccctaaaacttaaaagttttaaaactttttaacgttttaaaatttaaaccgttttccggggttaacggggttaaaccccggtttttaccggggaacccggttaaaaacgggggtaacccgttaaaacgggggtttaggggtaaaacctttaaagttaaccggaaaacggttaaaccggtaaaaccgtttacggggtttagggaccctttagggtaaacccccg

SEQ ID NO: 430406 - DNA, 603 bp, Homo sapiens
  misc_feature: GZ8MTXP02H2CW6.19.71.G05.1.454.CMB.2.raw
  modified_base (242)..(242): a, c, t, g, unknown or other
  modified_base (251)..(251): a, c, t, g, unknown or other
  modified_base (256)..(256): a, c, t, g, unknown or other
  modified_base (261)..(261): a, c, t, g, unknown or other
  modified_base (272)..(272): a, c, t, g, unknown or other
  modified_base (309)..(309): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctcctggctgtgtctcgtgggcgagccgggccacgatacgactgacaagtcagccacaatctttanacatacaanataanaactntagctagacanacagacacagactcgcctcgagctgctactagttcgnggactacgtacccggtaccgggtacgtccggtacccctacggtaccgtatacgaggtcggacgtcgggtccgggtacacgggtactagtacttaccactacccacctactactacgacgcgacgacgtacgacgacgacgtagagtagtagtagtagttagttattagttagtaactaactaattaattaattagttacgttacgtacggtacgtaccggtaacgtaacggtaacggtaacggtacgtaacgtacgtaacgtaacgtaacgtacgtagtacgtacgtacgtacg

SEQ ID NO: 430407 - DNA, 583 bp, Homo sapiens
  misc_feature: GZ8MTXP02HFQFQ.19.71.G05.1.454.CMB.2.raw
  modified_base (238)..(238): a, c, t, g, unknown or other
  modified_base (318)..(318): a, c, t, g, unknown or other
  modified_base (428)..(428): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaattcttttanacagttccaaacaatagaaaactacttagcttaggtaccagcagagaccaggacagcctcctaggctgctcatttaccgnggactacgtaccgtaaccgggacgtccgggtacccctagaccgtatcgaggtcggcgcgggtcgggtcgtagggactagtacttcactctaccacactcacgcacgtccngacgtagacgtagaagtgtggtgtacttagtttatagttagtaactaaataattattaattacgttacgttacggtacggtacgttacggacgtaaagggtacgtaggtacgtatacgtaacgaacggtaacgtacgtggtacgtacgtacgtac

SEQ ID NO: 430408 - DNA, 530 bp, Homo sapiens
  misc_feature: GZ8MTXP02FHNU3.19.71.G05.1.454.CMB.2.raw
  modified_base (239)..(239): a, c, t, g, unknown or other
  modified_base (315)..(315): a, c, t, g, unknown or other
  modified_base (358)..(358): a, c, t, g, unknown or other
  modified_base (416)..(416): a, c, t, g, unknown or other
  modified_base (508)..(508): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatctttanacagttccaacaatgaaaactacttagcttggtaccagcagagaccaggacagcctcctaggctgctcatttacgnggcatcgaccggacgtccggggtcccctgaccattcagtggcnggcgggtctgggacagtatttcactctcaccatcagcacgcctgcgaggctagaaagntggtggacttagtttatattcgtactaaactaattattaattattacgttcggtacggtacgttcggaccgtaaaggacgtaaggtgaatanaacgagacgtactgtcgctgcg

SEQ ID NO: 430409 - DNA, 582 bp, Homo sapiens
  misc_feature: GZ8MTXP02G8H29.19.71.G05.1.454.CMB.2.raw
  modified_base (404)..(404): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccagtcgagaggtctaggagtggcgtagggaaggacatatttcatcgtaccaagacgtggaaactaacaaattatacgacaccaatctgttgagagtcgactgacaatcaaacgtagacacaatacgaaanaacctagttcctaccgtagacacgtctacgtacctcgttcgtacgaccgtacccggaggacgtacgggtagttaatagttacgtaggtacgggaaacgaccggacccccaagtacgaacctagtaccggaaccctaacccgttcgtaccttacgttcgggtacgttacgtttaaacgg

SEQ ID NO: 430410 - DNA, 506 bp, Homo sapiens
  misc_feature: GZ8MTXP02H9IDI.19.71.G05.1.454.CMB.2.raw
  modified_base (343)..(343): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtgaagccctcgcagacccctctcgctcacctgtgccatcgtccggggacagagtcgctagcgacagtgttgcttggcacgtgggtcaggcagtccccatcgagaggtctagagtggcgtggggaagacatattcatgtaccanacgtgaaatacaaattatgcaccatctgttgagagtcgactgacaatcaacgtagacacatacgaagaaccagttcctacctgacagtctcgacctctcgtcgacctccgacggacgtacgggtctatattaacgtgtacggaacgacggaccccagtacgac

SEQ ID NO: 430411 - DNA, 598 bp, Homo sapiens
  misc_feature: GZ8MTXP02F0ZCA.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcgttggcacgtgggtcaggcacgtccccatcgagaggtctagagtggcgtgggaagacattatttcattcgtccaacgacgtaggaaataacaaattatgacacctaatctagttacgagtagtcgaactagaacaaatacgtaaacgtacgaactaacgaatacgaaaacgtaaccgtacgttacctacccgtggaccagtcctacgtacccttcgtcggtacgtaccgttacccggaaacggtaccgtaaccgggttagttaacgttaacgtttaacgtagggttaacgggaaacgaccgggtaaccccctaagtaaaccgg

SEQ ID NO: 430412 - DNA, 569 bp, Homo sapiens
  misc_feature: GZ8MTXP02G7UYF.19.71.G05.1.454.CMB.2.raw
  modified_base (226)..(226): a, c, t, g, unknown or other
  modified_base (237)..(237): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgccccacggggacatcgtgatgacccagtctccagactccctggctgtgtctctgggcgagcgggccaccatcaactgcaagtccagccanaattcttttanacagttccaacaatagaaaactacttagcttgtaccagcagagaccaggacagcctcctaggctgctctatttactgggcatccgtaacccggggaatcccggggtcctcgaccgattcagtggcaggcgggtctggggacagtatttcactctcacatcagcagcctgcgaggctagaagatggtaggacttagtttattagttagtactaaactaaattattaattattaacgtttcgtagggtacgtttaccggaccgaaacgggtaccgtaaagggtacgtaacgtatacgaaggtaacgtaaacgtggtaggtctacggactaaccg

SEQ ID NO: 430413 - DNA, 602 bp, Homo sapiens
  misc_feature: GZ8MTXP02GDJ5Q.19.71.G05.1.454.CMB.2.raw
  modified_base (243)..(243): a, c, t, g, unknown or other
  modified_base (325)..(325): a, c, t, g, unknown or other
  modified_base (363)..(363): a, c, t, g, unknown or other
  modified_base (384)..(384): a, c, t, g, unknown or other
  modified_base (441)..(441): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactgacaagtccagccacaattctttanacagttccaacaatagaaactacttagcttaggaccagacagacgaccaggacagcctaccgtaggctgctactatttacgngggctactaccgtacccggggaatcccggggtcccccnggacccgtattcgagtcggcngggcgggtactagggacagtattcactctcacatcagcagccctgcaggctagaagntggtcggtacttagtttattagttacgtaactaaattaattaatttatttaacgtcgtttacggtacgggtaccgttacggaccggtaaaacggggtaccgtaaaggggttagtaacttagtaacgaaacggtaacgtaacgttaggcggtacttcgaacc

SEQ ID NO: 430414 - DNA, 591 bp, Homo sapiens
  misc_feature: GZ8MTXP02HJEQN.19.71.G05.1.454.CMB.2.raw
  modified_base (331)..(331): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccaccatcaactgacaagtccagccaactaattcttttatactagttacccaaacaatagaaaactacttagcttaggtaccagcaagagaccaggacacgcctccgtaggctgctactatttacngggcatccgtacccggggaagtcccggggtccccctggacgcgtattcgaggtcggcgagggtcgggtcgtaggggactaggtactttccaccttcctaccaccactcaacgcacgccctgaccgaggctaggaagtagttggtcggacttaggtttattaagttgtaactaaataattatttattattacttcggtggtacgttcgacgaaacgggaccgtaaggtgtaataagtacgagaacgtatggtacgtctacg

SEQ ID NO: 430415 - DNA, 606 bp, Homo sapiens
  misc_feature: GZ8MTXP02IZXBZ.19.71.G05.1.454.CMB.2.raw
  modified_base (242)..(242): a, c, t, g, unknown or other
  modified_base (310)..(310): a, c, t, g, unknown or other
  modified_base (318)..(318): a, c, t, g, unknown or other
  modified_base (378)..(378): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaagtccagccacaattctttanacagttccaaacaatagaaaactacttagcttggtaccagcagagaccaggacagcctcaggctgctnatttacgnggctatccgtacccggggaattccccggggtccccctagaccgtattccgaggtcggcgnggtcggggtactgggacctagtactttaccgactcctacaccctatacacgcagccctagaccgaggactagaaagtgttaggtacggtattaaggttttaattagttacaactaaactaattaatttagttactacgttcggtacggtaccgtttacggacgtaaacgggtacgtaagggtacggtatacgtaacgaaggtaacgtaacgtggtacggctacgaacc

SEQ ID NO: 430416 - DNA, 570 bp, Homo sapiens
  misc_feature: GZ8MTXP02F3BNB.19.71.G05.1.454.CMB.2.raw
  modified_base (366)..(366): a, c, t, g, unknown or other
  modified_base (514)..(514): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccggggacagagtcgctagcgacagtgttgcttggcacgtgggtcaggcacgtccccatcgagaggtctagagtggcgtggggaagacatatttcatcgcaacacgtagaaatacaaattanagacaccatctagttagaagtagtcgaactagaacaaatacaaacgtagaacaacatacgaaacgaacctacgttcctacccgtcgacacgtacctcgtaaccctcgtacgttacgaccgttacccggaaacggaccgtaacggggtnttaaacgttaacgttaacgtggtaacggaacgtaccggaccccctaagtaaaccgg

SEQ ID NO: 430417 - DNA, 584 bp, Homo sapiens
  misc_feature: GZ8MTXP02I2AIG.19.71.G05.1.454.CMB.2.raw
  modified_base (239)..(239): a, c, t, g, unknown or other
  modified_base (314)..(314): a, c, t, g, unknown or other
  modified_base (369)..(369): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccacaattctttanacagttccaaacaatagaaaactcttagcttggtaccagcagagaccagacagcctctaggctgctcatttacgnggcatccgtaacccggggatccccggggtcccctggaccgtattcgagttcggcnggcgggtctgtcgacagtatttcacttctaccaccatcaagtcacgcctgcaggctagaaagtgttcgtggacttagtttaactattagtacaaataattatttaattacttaaccgtttggtaggttaccgttacggaaacccgtaaaggggtacccgtaaaagggtcggtaataacggttacaacggaaccgtaacttcgggtaggtcctacg

SEQ ID NO: 430418 - DNA, 653 bp, Homo sapiens
  misc_feature: GZ8MTXP02F0Z3R.19.71.G05.1.454.CMB.2.raw
  modified_base (236)..(236): a, c, t, g, unknown or other
  modified_base (247)..(247): a, c, t, g, unknown or other
  modified_base (313)..(313): a, c, t, g, unknown or other
  modified_base (345)..(345): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttaanacagtaccaanaatagaaactactagcttagaccagacagacgaccaggacagccctcgtagctgctactattacgnggctacgtccgtaaccggacgtcccgggtccncgaccgtattacgaggtcggaccgagggtccggggtcgtaggggactagttactttaccaccttcctaccacctagtacgacgccgacgtcccgtacgacgacggtctaggaagtacgtggtaggtacttagttttagttagttacgtaacctaaattaatttaatttaacttaacgtttaccgtttacgggttacggttaaccggttaccgggaaaccggtaaaacggggtaaccgtaaagggtacggtaagttacgtaacgtaacggtaaaccggtaacgttacggtacggtactacgacctaccg

SEQ ID NO: 430419 - DNA, 536 bp, Homo sapiens
  misc_feature: GZ8MTXP02F9BB8.19.71.G05.1.454.CMB.2.raw
  modified_base (234)..(234): a, c, t, g, unknown or other
  modified_base (245)..(245): a, c, t, g, unknown or other
  modified_base (309)..(309): a, c, t, g, unknown or other
  modified_base (341)..(341): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaanaatgaaaactctagcttggtaccagcagagacctaggacagcctcctaggctgctcatttacgnggcatccgtaccggagtccgggtcctgacctntcgagtcgcaggtcgggtctagggacagtacttcactcacacatcagcacgcctgcgaggtctagaagtagtggtagtacgttaagtttattagttataactaaataattaattaattacttacgttcgtaggtacgtacggacgtaaacggacgtaaggtcgactatacgaagacgactggcgactacgactac

SEQ ID NO: 430420 - DNA, 651 bp, Homo sapiens
  misc_feature: GZ8MTXP02F9V2W.19.71.G05.1.454.CMB.2.raw
  modified_base (379)..(379): a, c, t, g, unknown or other
  modified_base (584)..(584): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatctccggggacagagtcgctagcgacagtgttgcttggcacgtggtcaggcacgtccccatcgagaggtctaggagtggcgtaggggaagactagttatttcattcgtccaaacgacgtaggaaacttaacaaaatttacngtaccaaccctattccgtaggtttaggaagtaacggttaccggaaccttaggaaacctaaaatcccgaaaacggttacgaaccaaccaagttaccggaaaaggaacccctaagtttcccgtacccctaggacctaaggtcctacggaaccccttaccgtggttaccgacccgttccccgggaaagggtaccgtaaccgggggttnttaaacgttaacgtttaaccggttagggtacgggaaaacggtacccgggaccccctaaagttaaccg

SEQ ID NO: 430421 - DNA, 630 bp, Homo sapiens
  misc_feature: GZ8MTXP02IGI9J.19.71.G05.1.454.CMB.2.raw
  modified_base (243)..(243): a, c, t, g, unknown or other
  modified_base (321)..(321): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccgatacaactgacaagtccagccacaatcttttanacagttccaaacaatagaaactacttagctggtaccagcagacgaccaggacagcctctaggctgctcatttaccggnggactactaccgtaccgggtacgtcccgggtcccctagaccgtagttcgaggtcggcgtacggggtcgggtacgtaggggaactagtactttaccaccttcctaccacctactacgaacgacctacgccgtagaccgagggtcgtacgtaagtagtaggtggtacgttaagtttatttattacgtaactaactaattaatttaattaacgttacgttacgttacggtacggttacggtacgtaaacggtaacgtaacggtacggtagtacgtaacgaacgtaacgtacgtagtacggtacgtacgtacg

SEQ ID NO: 430422 - DNA, 510 bp, Homo sapiens
  misc_feature: GZ8MTXP02F53HE.19.71.G05.1.454.CMB.2.raw
  modified_base (341)..(341): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctggggaaggacatatttcatgtaccaacacgtggaatacaaattangcaccatctgttgagagtcgactgacaatacaaacgtagacacatacgaagaaccagttcctacctgcagctcgacctctgtgacctcccgaggacgacgggtagtatattacgtagtaggaacgacggaccccatacgacatcgccacctcgtctcgtggtcgcgtag

SEQ ID NO: 430423 - DNA, 654 bp, Homo sapiens
  misc_feature: GZ8MTXP02H9CJM.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaacgccctcgcacgaccctctcgctcacctgtcgccatcgtccggggacagacgtcgctagcgacagtgtgcttggctacgtgggtcaggcacgtccccagtcgagtaggtctaggacggtggacgtggggaaacgactagttacgtttcattcgtacccaaagtacggttagggaaacttaacgtaaaatttactacgaccaaccattcgtaggtttacggaagtaacgtaccgactacgaaactaaactacaaaacggtaagaaccaacgtaagtaaccggaaaacgtaaaccccgtagtttaccctcccgtaggacctacgtaccgttacgaccccttagtcggttaccgaacccgttacccgggaaggtaaccgtaacggggttacgttaaattaacgttaaaccgtagggttaacggaaacggtacccggtacccctaaagtaacg

SEQ ID NO: 430424 - DNA, 518 bp, Homo sapiens
  misc_feature: GZ8MTXP02J2FEB.19.71.G05.1.454.CMB.2.raw
  modified_base (419)..(419): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtggtcaggcagtccccatcgagaggtctagagtggctggggaagacagtatttcatgtaccaacacgtagaactacaaattatgcaccatctgttgagagtcgatgacaatacaagtagacacatacgaagaaccagttacctccctgacagctcgacctntcgtacgacctcccggaggacgacgggttagtatagttactggtaggaacgacggacccctagacgactactcgcctactcgtctcgtcggtcgactag

SEQ ID NO: 430425 - DNA, 520 bp, Homo sapiens
  misc_feature: GZ8MTXP02JAHIS.19.71.G05.1.454.CMB.2.raw
  modified_base (341)..(341): a, c, t, g, unknown or other
  modified_base (357)..(357): a, c, t, g, unknown or other
tcagtactctcgtgcacgaccggtgctcgatttagtgtcgtcgcaagagagaggggggcagagtctgctgaattctggctgaccagggcagtcaccagagctccagaaaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccagtcgagaggtctagagtggctgggaagcatattcatgtccancgtagaatacaattangacaccatctgttagagagtacgactgacaatacaagtacgacacatacgaacgacctagttcctcctagcagctacgacctctacgtacgaccgtcccggaaggaccgacggttacgtattacgttaacgtggtacggaacgacggacccctagtacgaacg

SEQ ID NO: 430426 - DNA, 531 bp, Homo sapiens
  misc_feature: GZ8MTXP02FQYZH.19.71.G05.1.454.CMB.2.raw
  modified_base (245)..(245): a, c, t, g, unknown or other
  modified_base (327)..(327): a, c, t, g, unknown or other
  modified_base (345)..(345): a, c, t, g, unknown or other
  modified_base (372)..(372): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacngtgttgcttggcacgtgggtcaggcacgtccccatccgagaggtctagagtggctggggaagacatatttcattgtaccaanacgtagaactacaaattngcaccatctgttagagagtcgatgaanaatcaaacgtagaacacatacgaagaaccagttctaccctgacagctacgacctctgtcgacctccggacgacgtacggtatagtattacgtaggtaggaacgtacggaccccaatacgacacgtacgaacctaccgtcgtctcgtggtcgactttagg

SEQ ID NO: 430427 - DNA, 524 bp, Homo sapiens
  misc_feature: GZ8MTXP02G9FY6.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagagtctagagtggctggggaagacatatttcattcgtccaacacgtggaaatacaaattatgacacatactgttgagagtcgactgaacaatacaaacgtagacacatacgaagaacctagttctccctagacagctcgacctctcgtacgacctacccggacggtacgacgggtgttaagtaacgttacgtacggtaggaacgacggaccccgagtaacg

SEQ ID NO: 430428 - DNA, 636 bp, Homo sapiens
  misc_feature: GZ8MTXP02IK79R.19.71.G05.1.454.CMB.2.raw
  modified_base (205)..(205): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctcgcacgacccctctcgctcacctgtcgccactccgtccggggacagagtcgctagcgacagtgttgcgtttggcacgtggtcaggcacgtccccatcgagaggtctagagtggcgtacgggaaggacattatttcgattcgtaccaaacgtacgtaggaaataacctaaattatgaccacatctgttagaagtagtcgactagaactaataccgaaagtaacacgaaactagtaacggaaacgaaaccctagttaccctacccgtacgacgtaccgtaccgtacgtaacccttcgtacggttaccgaaccccgttaccccggggaaacggtaaacccggtacggggttaacgttaaacgttaaacgtttacgtacggggttaacggaaaaccgggtacccggaaccccccgtaagtaaacccgg

SEQ ID NO: 430429 - DNA, 506 bp, Homo sapiens
  misc_feature: GZ8MTXP02HX28S.19.71.G05.1.454.CMB.2.raw
  modified_base (367)..(367): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggtcacgtccccagtcgagaggtctaggagtggctaggggaacgactatattcatcgccacgacgtagaaatacaaattngacacatcgtagtgagagtcgactgacatacaacgtagacacatacgaagaccagttctaccgtgcagtctacgactactcgtcgaccgtccgaggacgcgggtactatataacgtgtacggaacgcgacccatacgac

SEQ ID NO: 430430 - DNA, 637 bp, Homo sapiens
  misc_feature: GZ8MTXP02HAY4Y.19.71.G05.1.454.CMB.2.raw
  modified_base (241)..(241): a, c, t, g, unknown or other
  modified_base (264)..(264): a, c, t, g, unknown or other
  modified_base (267)..(267): a, c, t, g, unknown or other
  modified_base (314)..(314): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgacaagtccagccactaattcttttaanactactaccaataatagaaactntanctagacagacagacgaccagacacgcctacgagctgctactattcgnggactacgtccgtaaccgggacgtcccggggtccagaccgtagttcgaggtcggcgagggccgggtacgtagggactacgtacttcaccgtctacactactacgagcacgtcctcgacgacggtactagaagtagttggtacgtacgttaagtttattagttacgtaaactaaacttaaatttaaactttaattaacgttacgttaggtacggttaccggttaccgggaaccggtaaacgggtaaaccggtaaagggtacgtaaacgttacgtaacgtaacggtaacgtaacggttacgggtacggaccgtacgacgtaaccg

SEQ ID NO: 430431 - DNA, 641 bp, Homo sapiens
  misc_feature: GZ8MTXP02IDCCU.19.71.G05.1.454.CMB.2.raw
  modified_base (238)..(238): a, c, t, g, unknown or other
  modified_base (315)..(315): a, c, t, g, unknown or other
  modified_base (353)..(353): a, c, t, g, unknown or other
  modified_base (363)..(363): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttaggtaccagcagagaccaggacagcctctaggctgctcatttacngggcatccgtacccgggaatccggggtcccctgaccgnttcagtggcnggcgggtctggggacagtactttcactctcacctatcagcagccctggcagggctagaaagtgtggtgggtattaaggtttttattagtttagtaaccctaaaacgttaaatttaaatttaatttaaacttaccgttttaccggtttaggggtaaccggttttcccgggaacccgtaaaacgggggtaacccgtaaaagggggttcggtaaattaacgttaacccgaagggtaaaccgttaaaaccggtgggtttacgggcccgtttaggaacccccg

SEQ ID NO: 430432 - DNA, 796 bp, Homo sapiens
  misc_feature: GZ8MTXP02HGRRY.19.71.G05.1.454.CMB.2.raw
  modified_base (261)..(261): a, c, t, g, unknown or other
  modified_base (756)..(756): a, c, t, g, unknown or other
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtacgacgccctcgcacgaccctctcgcctcacctgtcgcctacgtccggtaccgggganaggacgtccgacgtacgcgacgtaggttggttcgtcgtttcggctacgggttcgggtaccgacggaccgtaccgtccccgtaggtacccggtaggtacggttaccggtaaaggtcggggtacgggtaccggttaacgggggaaacggtaacttaaacgtttacgtttacgtaacgttaccggtaaccccgtaaaacggtaccgggttaaaggtaaaaccgtttaaacttaaaagtttacgttaccggaaaccctaacccttaaagtttcgggttaggttaacgggtaaacgttaacggttacccggaactttaaacgggaaacctaaacgtaaccgttaaaacggactaaccgtaaacgtaacgtaaccgaaaccgtaacccgttacgttccctaccgtagaacggcttaccgtacctacccgtagtaccggtacgtaaccccggtacgggaaaacggtccggttaagtacgttaaacgttaacgtttaaccggnggtaaaaccgggacctaccccggtaaccctaagtaaccgg

SEQ ID NO: 430433 - DNA, 604 bp, Homo sapiens
  misc_feature: GZ8MTXP02GMAKG.19.71.G05.1.454.CMB.2.raw
  modified_base (239)..(239): a, c, t, g, unknown or other
  modified_base (326)..(326): a, c, t, g, unknown or other
  modified_base (422)..(422): a, c, t, g, unknown or other
  modified_base (427)..(427): a, c, t, g, unknown or other
  modified_base (434)..(434): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccacgatacgaactgacaagtccagccacaatcttttaanactacgttaccaaacaatacgaaaactactagacttacgacagacaagacgaccgaggacacgcctacgagctgctctagtttacgnggactacgtaccgtaccgggtacgtcccgggtacccctacgaccgtattcgaggtcggacgcgggtcgggtcgtagggacagtattcactcacacnacgancacgacncgcgacgacgagagagtagtgtagtagttattattagtactaactaaattaattaattaattacgttacgtacggttacggttaccggtaaccggtaaacggtaaacggtaacggtaacggtaacgtaagtaacgaacgtaacgtacgtacggtacggtacgtacgtacg

SEQ ID NO: 430434 - DNA, 584 bp, Homo sapiens
  misc_feature: GZ8MTXP02IS2C7.19.71.G05.1.454.CMB.2.raw
  modified_base (368)..(368): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagtgtgcttggcacgtgggtcaggcacgtccccatcgagaggtctagagtggctggggaagacattatttcattcgtccaaacacgtagaaatacgaaattangacacctatctgttgagagtcgactagaacaactacaaacgtagaacaacgtaatacggaaagaaacccgtaagtttcctaccctagacctaagtctacgaacccttctacgttacggaacccttaccccggaaggtaacccgtacggggttacgttaacgttaacgttaccgtagggttacggaaacggtaccgggtaccccctaaagtaaaccg

SEQ ID NO: 430435 - DNA, 549 bp, Homo sapiens
  misc_feature: GZ8MTXP02F9I1Z.19.71.G05.1.454.CMB.2.raw
  modified_base (239)..(239): a, c, t, g, unknown or other
  modified_base (317)..(317): a, c, t, g, unknown or other
  modified_base (371)..(371): a, c, t, g, unknown or other
  modified_base (419)..(419): a, c, t, g, unknown or other
  modified_base (429)..(429): a, c, t, g, unknown or other
  modified_base (432)..(432): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaaacaatagaaaactacttagcttggtaccagcagagaccaggacagcctcctaggctgctcatttacgngggcatccgtacccggggaatcccggggtccccctagacccgattcagtcggcngggcgggtctggggacagtatttccactctcaccatcagcagcctgcnggctgaaagntgnggctagtttattatgtacaataattattattatacgttcgtaggtacgtttcggaccgtaaaggggaccaaagggtacgattacgtaacgaggaaccgtaacgtgtggcctaggacc

SEQ ID NO: 430436 - DNA, 496 bp, Homo sapiens
  misc_feature: GZ8MTXP02G28J4.19.71.G05.1.454.CMB.2.raw
  modified_base (225)..(225): a, c, t, g, unknown or other
  modified_base (234)..(234): a, c, t, g, unknown or other
  modified_base (245)..(245): a, c, t, g, unknown or other
  modified_base (271)..(271): a, c, t, g, unknown or other
  modified_base (291)..(291): a, c, t, g, unknown or other
  modified_base (297)..(297): a, c, t, g, unknown or other
  modified_base (326)..(326): a, c, t, g, unknown or other
  modified_base (335)..(335): a, c, t, g, unknown or other
  modified_base (370)..(370): a, c, t, g, unknown or other
  modified_base (374)..(374): a, c, t, g, unknown or other
  modified_base (376)..(376): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcacgatcactgcaagtccagccanaatctttanacagttccaanatgaaaactctagctggaccagcagnaccaggacagctcagctgcnattcgngcatcgtaccggagtccggccctgacgtntcagtgacnggtcggtcgaggacagtacttcactcacacatcancacncncgcgacgacgagagagtgtgtagtagttattatagtataataatattattatactagtacgtacgtacgacgacgacgacgtacgtatataagacgacgtacgtagtacgtcgtacgacg

SEQ ID NO: 430437 - DNA, 536 bp, Homo sapiens
  misc_feature: GZ8MTXP02G3OZJ.19.71.G05.1.454.CMB.2.raw
  modified_base (342)..(342): a, c, t, g, unknown or other
  modified_base (417)..(417): a, c, t, g, unknown or other
  modified_base (456)..(456): a, c, t, g, unknown or other
  modified_base (529)..(529): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcactgggtcaggcagtccccatcgagaggtctagagtggctggggaagacatatttcatgtccaagacgtaggaactacaaatttangcaccatctgttgagagtcactgacaatcaaacgtagacacatcgaaagaaccagttcctaccctagacacgtcncgtacctcgtgtacgacctcccggaggtacgacgggttntaagtattaccgtagtacggaagaaccggccccaaagtacgacctagtcgaacctctacggtctccgtggtcnctttaag

SEQ ID NO: 430438 - DNA, 609 bp, Homo sapiens
  misc_feature: GZ8MTXP02G9LZA.19.71.G05.1.454.CMB.2.raw
  modified_base (236)..(236): a, c, t, g, unknown or other
  modified_base (247)..(247): a, c, t, g, unknown or other
  modified_base (314)..(314): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgacaagtccagccacatctttanacagttccaanaatagaaaactctagcttaggtaccagcagagaccaggacagcctctaggctgctctatttaccggnggctacgtaccgtaccggacgtccgggtccacgaccgtattcgaggtcggacgtagggtccgggtcgtaggggaactagtactttacgaccttcctaccacctatcacgacgacgcgtcgacgacgacgtagtaagtagtagtagtacgttagtttagtttagttagttaactaactaattaatttaattaattacgtttacgttacggttacggttacggtaccggtaacggtaacggtaacggtacgtacgtagtacgaacgtacgtacgtacgtacgtacgtacgacgtacg

SEQ ID NO: 430439 - DNA, 543 bp, Homo sapiens
  misc_feature: GZ8MTXP02I3FHF.19.71.G05.1.454.CMB.2.raw
  modified_base (228)..(228): a, c, t, g, unknown or other
  modified_base (237)..(237): a, c, t, g, unknown or other
  modified_base (361)..(361): a, c, t, g, unknown or other
  modified_base (415)..(415): a, c, t, g, unknown or other
  modified_base (421)..(421): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaaacaatagaaaactacttagcttggtaccagcagagaccaggacagcctcctaggctgctcatttactgggcatctacccgggaatccggggtcccctgaccgtattcagtggcnggcgggtctgggacagactttcactctcaaccatccagcacgcctagcaggtcngaaagnttgaggtctagttttattattagtcaaactaattaattattaatacttcgtacggacgtttacgaccgtaaagggtaccaaggtacggattaagcaagaaccgtacgtgtaggtctacgacc

SEQ ID NO: 430440 - DNA, 573 bp, Homo sapiens
  misc_feature: GZ8MTXP02HCAH8.19.71.G05.1.454.CMB.2.raw
  modified_base (246)..(246): a, c, t, g, unknown or other
  modified_base (259)..(259): a, c, t, g, unknown or other
  modified_base (327)..(327): a, c, t, g, unknown or other
  modified_base (353)..(353): a, c, t, g, unknown or other
  modified_base (367)..(367): a, c, t, g, unknown or other
  modified_base (376)..(376): a, c, t, g, unknown or other
  modified_base (429)..(429): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccacgatacgaactgacaagtccagccactaattcttttanacagttaccaaanaatagaaaactcttagcttaggaccagcagagaccaggacagcctacctaggctagctctatttacgnggcatccgtaccggatccgggtcccngacctatcagtgcnggtcggtcngggactagtactttcactctcacctatcagcacgcctgcgaggactagaaagngttggaggtattaggttttaattagttagtaacctaaataatttaatttaattacttacgttaccggtaggtaccgtttacggaccgtaaagggaacctaagggtacgaatacgtaacgagtaacgaacgtggacgcgtagacc

SEQ ID NO: 430441 - DNA, 575 bp, Homo sapiens
  misc_feature: GZ8MTXP02GID7G.19.71.G05.1.454.CMB.2.raw
  modified_base (317)..(317): a, c, t, g, unknown or other
  modified_base (460)..(460): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctgggccttccacaaggtgtcctgtcacaagtacagctgcagcagtcaggtccaggactggtgaagccctcgcagaccctctcgctcacctgtgccatctccggggacagagtcgctagcgacagtgttgcttggcacgtggtcaggcagtccccatcgagaggtctagagtggctgggaagcatatttcatgtccaanacgtggaatacaaattatgcaccatctgttgagagtcgactgacaatcaacgtagacacatacgaagaacctagttccaccctgacaggtctacgacccttatgttacgaacccgttcccggaaggtaccgaaccgggggttnttaagtaacgtttaccgtaggttacgggaaacggaccgggtacccccaagtacggtaccagttacgaaccctaaaccgttccggttcttacgtcgggttacgaccgtttaaacgg

SEQ ID NO: 430442 - DNA, 562 bp, Homo sapiens
  misc_feature: GZ8MTXP02JDPD4.19.71.G05.1.454.CMB.2.raw
tcagtactctcgtggcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgttgcttggcacgtgggtcaggccacgtccccatcgagaggtcagagtggcgtgggaagactatatttcatcgtaccaaacacggtaggaactaacaaattatagacaacctatctgttgagagtcgactgaacaaatcaaacgtagaacacaagtacgaaacgaaccacgttacctccctagaccagcctacgacctcgtcgtacgaccgtcccggaggaccgtacggggtataagtattacgtggtacggaacggaccggtaccccagtacgaacgactacccaacgtcgtctcgtgtcgtacttagtacgg

SEQ ID NO: 430443 - DNA, 556 bp, Homo sapiens
  misc_feature: GZ8MTXP02I15CT.19.71.G05.1.454.CMB.2.raw
  modified_base (239)..(239): a, c, t, g, unknown or other
  modified_base (317)..(317): a, c, t, g, unknown or other
  modified_base (439)..(439): a, c, t, g, unknown or other
  modified_base (553)..(553): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanactagttaccaaacaatgaaaactactagcttggaccagcagagaccaggacagcctcgtaggctgctctatttacgnggctactcgtacccggggaatcccggggtccccctgaccgtattcgagtcggcagggtccgggtcgtaggggaccaggtactttccacgtctcacctatccagcagcctgcgagctagaagntgtggctagtttatacttagactaaataattagttattaatcgttacgtaggtaccgttcgacgtaagggactaggtagattaacgcgtaaggaaccgtacgtgtcggcgtacnccg

SEQ ID NO: 430444 - DNA, 557 bp, Homo sapiens
  misc_feature: GZ8MTXP02FS2PI.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagaggtctagagtggctgggaaggacatattcatcgtccaacacggtagaaatacaaaattactagacacctatctagttgagacgtcgactgacaaatcaaacgtagacaacatacgaaagaacctagttcctaccctgacagtctacgacccttctacggtacgaccgtaccccggaagggtaaccgacggggttattaagttaacgtttacgtaggtacggggaaacgtaccggaccccctaagtaaacgg

SEQ ID NO: 430445 - DNA, 589 bp, Homo sapiens
  misc_feature: GZ8MTXP02IULOC.19.71.G05.1.454.CMB.2.raw
  modified_base (235)..(235): a, c, t, g, unknown or other
  modified_base (243)..(243): a, c, t, g, unknown or other
  modified_base (252)..(252): a, c, t, g, unknown or other
  modified_base (256)..(256): a, c, t, g, unknown or other
  modified_base (261)..(261): a, c, t, g, unknown or other
  modified_base (263)..(263): a, c, t, g, unknown or other
  modified_base (283)..(283): a, c, t, g, unknown or other
  modified_base (285)..(285): a, c, t, g, unknown or other
  modified_base (305)..(305): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctcctggctgtgtctcgtgggcgaggcggggccacgactacgacgtcgactaagcagccanatctttanacatacaanatanaactntnctgacagcagacacgagacncnctcgagctgctctatttcgnggcacgtccgaccggtacgtcccggtccctacgaccgtattcgaggtcgacgtggtcgggtcggtacggacgtacgtacgttactactcctacctacctactacgacgacgacgcgtcgacgacgacgtagagtagtagtagtacgttagttattagttacgtactaactaattaattattacttacgttacgttacggtacggttacggtacggtaaacggtaacggtacggtacgtaacgtacgtaacgaacgtaacgtacgtacgtacgtacgtacgtacg

SEQ ID NO: 430446 - DNA, 599 bp, Homo sapiens
  misc_feature: GZ8MTXP02JWV7T.19.71.G05.1.454.CMB.2.raw
  modified_base (283)..(283): a, c, t, g, unknown or other
  modified_base (314)..(314): a, c, t, g, unknown or other
  modified_base (343)..(343): a, c, t, g, unknown or other
  modified_base (360)..(360): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaaacaatagaaaactacttagcttggtaccagcaganaccaggacagcctcaggctgctcatttacgnggcatccgtaccgggatccggggtccccngaccgattcgagtggcnggcgggtcgtgggacagtactttcactctacaccatcagcagcctgcgagcgtagaacgtagtggtggtacttaagtttatttattcgtactaaactaaatttaatttatttaacttacgttacggttacgggtaaccggttacggtaacccggtaaacggggtaccgtaaaggggtacggtaattaagttaacgaaacggtaacgtaaaccgttgggtacggtaccgtacggaacccg

SEQ ID NO: 430447 - DNA, 526 bp, Homo sapiens
  misc_feature: GZ8MTXP02J04ZT.19.71.G05.1.454.CMB.2.raw
  modified_base (347)..(347): a, c, t, g, unknown or other
  modified_base (436)..(436): a, c, t, g, unknown or other
  modified_base (487)..(487): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgcccatctccggggacagagtcgctagcgacagtgttgcttggctacgtgggtcaggcagtccccatcgagaggtctagagtggctggggaagacatattcatgtccaaancgtaggaatacaaattatgacaccatctgttgagagtcgactgacaatacaaacgtagacacatacgaaagaacctaagttcctacccngaccagctcgaacctcgtatcggaaccctcccggaaggactaaccggggtnttaataagttacgtgtaggaacgacggcccccaagtacg

SEQ ID NO: 430448 - DNA, 612 bp, Homo sapiens
  misc_feature: GZ8MTXP02G59MU.19.71.G05.1.454.CMB.2.raw
  modified_base (239)..(239): a, c, t, g, unknown or other
  modified_base (248)..(248): a, c, t, g, unknown or other
  modified_base (253)..(253): a, c, t, g, unknown or other
  modified_base (262)..(262): a, c, t, g, unknown or other
  modified_base (308)..(308): a, c, t, g, unknown or other
  modified_base (356)..(356): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacgatacgaactgactaagtccagccacaattctttaanacatacaanaatanaaactctanctgacagcagacgacagacagtcctcgagctcgctactagttacgnggactacgtaccgtaaccgggtacgtcccggggtcctacggtaccgtnttacgaggtcgacgacggtcggtcggtacggtacgtagtacttactactactactactactacgacgacgacgacgtcgcgacgacgtagaagtagtagtagtacgttagtttattagttacgtaactaaactaaattaattaattaattacgttacgttacggtacggttacggtacggtaaacggtaacggtaacggtacgtaacgtacgtaacgtaacgtaacgtaacgtacgtacgtacgtacgtacgtacg

SEQ ID NO: 430449 - DNA, 542 bp, Homo sapiens
  misc_feature: GZ8MTXP02JLP53.19.71.G05.1.454.CMB.2.raw
  modified_base (370)..(370): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgtcatctccggggacagagtcgctagcgacagtgttgcttggcacgtgggtcaggcagtccccatcgagaggtctagagtggcgtaggggaagacagttattcatcgtccaacacgtaggaataacgaaatttangacactatactgttgagagtcgactagaacaatacaaacgtagaacacagtacgaaacgaacctaacgttcctacctagcagctacgaccctcgtcgtacgaccgtcccggacggacgacggggtattagtaacgttacgtaggtacggaacgaccggacccctagtaaccg

SEQ ID NO: 430450 - DNA, 629 bp, Homo sapiens
  misc_feature: GZ8MTXP02JAU7I.19.71.G05.1.454.CMB.2.raw
  modified_base (315)..(315): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttaccaaacaatacgaaaactactagcttggtaccagcagagaccaggacagcctcctaggctgctcatttcnggcatcctacccgggaatcccggggtccccctgaccgattcagtggcaggcgggtcgtaggggacaggtaactttccgaacttcctaccaaccctataccaaggccaacggtcccctagacccgaagggcctaggaaagtatgggtagggaccttagttttatttacgttagtacctaaataattatttaatttactaacgttcggttaacggtaccgtttcggaacccgtaaaaggggtaacctaaaaggggtcgtaattaacgaacgtaaaggaaccggttaaacgtaggttcgggacccttaggaaccccg

SEQ ID NO: 430451 - DNA, 583 bp, Homo sapiens
  misc_feature: GZ8MTXP02H4G6R.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgcccatctccggggacagagtcgctagcgacagtgttgcttggcacgtgggtcaggcagtccccatcgagaggtctagagtggctggggaagacatatttcattcgtccaaacgtacgtaggaaatacaaagttatagaccaccatctgttagagtagtcgactgaacatacaaacgtagacactaatacgaaacgaacctagttaccctacccgttacgacaacggtctacggtaacccttcgtacgttacgaaccctaccccgggacggtaaaccgtaccggggttagtaacgttaacgttaccgtaggttacggaaacggaccgggtaccccctaagtaaaccgg

SEQ ID NO: 430452 - DNA, 526 bp, Homo sapiens
  misc_feature: GZ8MTXP02F7Y9J.19.71.G05.1.454.CMB.2.raw
  modified_base (238)..(238): a, c, t, g, unknown or other
  modified_base (282)..(282): a, c, t, g, unknown or other
  modified_base (312)..(312): a, c, t, g, unknown or other
  modified_base (355)..(355): a, c, t, g, unknown or other
  modified_base (415)..(415): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttccaaacaatagaaaactacttagcttggaccagcaganaccagacagcctctaggctgctcatttacnggcatctaccggaatccggggtcccctgaccgattcagtggcnggcgggtctgggacagtatttcactctcaccatcagcagcctgcagctgaagatggtcgntagtttatattcgactaaacaattaattattaatacttacgtcgtaacgttggacccgaaagggtaccaaggtacggataataacgaagaaccgtaacgtgtagctagacc

SEQ ID NO: 430453 - DNA, 745 bp, Homo sapiens
  misc_feature: GZ8MTXP02H3SLF.19.71.G05.1.454.CMB.2.raw
  modified_base (225)..(225): a, c, t, g, unknown or other
  modified_base (234)..(234): a, c, t, g, unknown or other
  modified_base (312)..(312): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaacatagaaaactcttagcttggaccagcagagaccaggacagccctcgtaggctagctctaatttacgngggctatccgtaaaccccggggtaatcccggggtccctagacccgatttccgaaggttcgggactaagggtccgggggttctacgggggaacctagggttactttttaccgaactttcccttacccaaaccctaaacgttcgaaacggtcccgaacggtacccgttggacccgtaggggaccttagggaaaagtaagttgggttacggggtacttaaggtttttaaacttagtttacggttaacctaaaacgtaattttaaattaattttaaacgttacgtttacccgggtttaacggtaacccggttttaccgggaacccgttaaaacgggggaaacccctaaaagggggttaccggtaaacgtttaagtacccgaaaggtaaaccccggtaaacggttacggtacggggtcccttaggaccgtaaaccccg

SEQ ID NO: 430454 - DNA, 540 bp, Homo sapiens
  misc_feature: GZ8MTXP02FLTMP.19.71.G05.1.454.CMB.2.raw
  modified_base (228)..(228): a, c, t, g, unknown or other
  modified_base (237)..(237): a, c, t, g, unknown or other
  modified_base (312)..(312): a, c, t, g, unknown or other
  modified_base (359)..(359): a, c, t, g, unknown or other
  modified_base (416)..(416): a, c, t, g, unknown or other
  modified_base (436)..(436): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaacaatgaaaactacttagcttggtaccagcagagaccaggacagcctctaggctgctcatttacgnggcatccgtaccggggaatccggggtcccctgaccgattcagtggcnggcgggtctgggacagtatttcactctcaccatcagcagcctgcaggctagaaagtntggtggctagtttattagtntacaaatattattattatacgttcgtaggtaccgttacggaccgtaaaggggaacctaaaggggtacgtataatcgaagaaccgtaacgtgtaggctagaaccc

SEQ ID NO: 430455 - DNA, 515 bp, Homo sapiens
  misc_feature: GZ8MTXP02JZZSP.19.71.G05.1.454.CMB.2.raw
  modified_base (327)..(327): a, c, t, g, unknown or other
  modified_base (343)..(343): a, c, t, g, unknown or other
  modified_base (450)..(450): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagaggtctaggagtggctaggggaaggacatatttcatgtaccaacncgtagaatacaattancgacaccatctgttgagagtcgactgacaatacaacgtagacacatacgaagaacctagttcctccctagacagctcgacctctgtcgactccgaggacgacgggtntatattacgtgtaggacgacgacccatacgacactcgccaccgtcgtactcgtcggtacgcttag

SEQ ID NO: 430456 - DNA, 529 bp, Homo sapiens
  misc_feature: GZ8MTXP02HR2RM.19.71.G05.1.454.CMB.2.raw
  modified_base (324)..(324): a, c, t, g, unknown or other
  modified_base (347)..(347): a, c, t, g, unknown or other
  modified_base (489)..(489): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacaggagtcgctagcgacagtgttgcttggcactgggtcaggcagtccccatcgagaggtctagagtggctggggaaggacatatttcatgtccaaanacgtaggaaactacaaaatttangacaccatctgttagagtagtacgactgaacaatacaaacgtagacacatacgaagaaccagtcctcctgacagctgacctctgtcgacgtacccgacggacgacgggtacgtatagtacgtcgtaggaacgacgaccccanacgacatcgaacctaccgtcgtctcgtcggtcgtactacg

SEQ ID NO: 430457 - DNA, 573 bp, Homo sapiens
  misc_feature: GZ8MTXP02HFZTF.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatcgtccggggacagagtcgctagcgacagtgttgcttggcacgtgggtcaggcacgtccccatcggagaggtctaggagtggcgtggggaagactatatttcattgtccaaacgacgtaggaaataacaaattatacgacaacctatcgtagttagagtacgttacgacgtagaacaatacgtaaacgtacgaacaacgtaagtacgaaacgaaacctagttcctccctagacagtctacgaccctgtacgtcgaccgtacccggacggaccgacgggttacgttaacttaagttacgtaggtacggtaaacgaccggtaccccaagtaaccg

SEQ ID NO: 430458 - DNA, 593 bp, Homo sapiens
  misc_feature: GZ8MTXP02F20AK.19.71.G05.1.454.CMB.2.raw
  modified_base (244)..(244): a, c, t, g, unknown or other
  modified_base (321)..(321): a, c, t, g, unknown or other
  modified_base (344)..(344): a, c, t, g, unknown or other
  modified_base (349)..(349): a, c, t, g, unknown or other
  modified_base (360)..(360): a, c, t, g, unknown or other
  modified_base (368)..(368): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccgatcgaactgacaagtccagccacaatctttanacagttccaaacatagaaaactctaagcttggtaccagcagacgaccaggacagcctcctaggctgctcatttacgngcatcgaccggagtccccggtcngactntcgagtcgcgnggcggtgnggactagtacttcactctacacatacgacgcacgtcctcgcgacgacgtagaagtagtaggtaggtacgttaagtttaagttagttagtaactaaactaaattaattaattaacgttaacgttacggttacggttacggtaccggtaaccggtaaacggtaaccggtaacggtaaggtaacgtaacgtaacgtaacgtaacgtaacgtacggtacggtacgtacg

SEQ ID NO: 430459 - DNA, 546 bp, Homo sapiens
  misc_feature: GZ8MTXP02HOZ4P.19.71.G05.1.454.CMB.2.raw
  modified_base (420)..(420): a, c, t, g, unknown or other
  modified_base (518)..(518): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagacgtcgctagcgacagtgttgcgttggcacgtgggtcaggcagtccccatcgagaggtcagagtggcgtggggaaggacagtatttcatcgtccaaacacgtaggaataactaaattatcgacaaccatcgtgttagagtagtcgaatagaacaatacaaaggtanaacacagtacgaaacgaacctaagttcctccctagacacggtactacgaaccttcgtagtcgaccgtcccgaaggacgacggtagtataacgttacgngtacggaacgtacggacccctaagaacg

SEQ ID NO: 430460 - DNA, 571 bp, Homo sapiens
  misc_feature: GZ8MTXP02H5KQA.19.71.G05.1.454.CMB.2.raw
  modified_base (239)..(239): a, c, t, g, unknown or other
  modified_base (315)..(315): a, c, t, g, unknown or other
  modified_base (368)..(368): a, c, t, g, unknown or other
  modified_base (402)..(402): a, c, t, g, unknown or other
  modified_base (427)..(427): a, c, t, g, unknown or other
  modified_base (435)..(435): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttanacagttaccaacaatgaaaactacttagcttggtaccagcagagaccaggacagcctcctaggctgctcatttacngggcatcctaccccggggaatcccggggtccccctgacccgtattcagtggcnggccgggtctggggacagtatttcactctcaccntcagcagccctgcaggctagaaagntgtcggtntaggtttattattgtacaaataattatttaatttatacgtttacgtgggtaacgtttccggaacgaaaacggggtaccaagggtacggtaattagtaacgaacggaacgtaaacgttgtacgggtcttacggaccc

SEQ ID NO: 430461 - DNA, 505 bp, Homo sapiens
  misc_feature: GZ8MTXP02GAGP9.19.71.G05.1.454.CMB.2.raw
  modified_base (229)..(229): a, c, t, g, unknown or other
  modified_base (236)..(236): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (254)..(254): a, c, t, g, unknown or other
  modified_base (260)..(260): a, c, t, g, unknown or other
  modified_base (262)..(262): a, c, t, g, unknown or other
  modified_base (273)..(273): a, c, t, g, unknown or other
  modified_base (276)..(276): a, c, t, g, unknown or other
  modified_base (283)..(284): a, c, t, g, unknown or other
  modified_base (294)..(294): a, c, t, g, unknown or other
  modified_base (299)..(299): a, c, t, g, unknown or other
  modified_base (314)..(314): a, c, t, g, unknown or other
  modified_base (322)..(322): a, c, t, g, unknown or other
  modified_base (324)..(324): a, c, t, g, unknown or other
  modified_base (326)..(326): a, c, t, g, unknown or other
  modified_base (328)..(328): a, c, t, g, unknown or other
  modified_base (334)..(334): a, c, t, g, unknown or other
  modified_base (337)..(337): a, c, t, g, unknown or other
  modified_base (339)..(339): a, c, t, g, unknown or other
  modified_base (342)..(342): a, c, t, g, unknown or other
  modified_base (346)..(346): a, c, t, g, unknown or other
  modified_base (350)..(350): a, c, t, g, unknown or other
  modified_base (352)..(352): a, c, t, g, unknown or other
  modified_base (355)..(355): a, c, t, g, unknown or other
  modified_base (357)..(357): a, c, t, g, unknown or other
  modified_base (359)..(359): a, c, t, g, unknown or other
  modified_base (361)..(361): a, c, t, g, unknown or other
  modified_base (375)..(375): a, c, t, g, unknown or other
  modified_base (379)..(379): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggctcgacacgacgcactaagcagcanatcttanacatacanananatatantgacananagacgacaganacnctctgcnnctctatacgngcacncgtacgacgtcgccncgacatcngngngngcgcgnganantcnctcncacncncancncncncgacgagagagagngtgngtagtagttattatagtactaataattattattagttacgttacgtacggtacgtacggtaacggaacggtaacgtacgtacgtagtacgtaacgtacgtaacgtacgtagtacgacgtacgtacg

SEQ ID NO: 430462 - DNA, 579 bp, Homo sapiens
  misc_feature: GZ8MTXP02JVMKQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctctcgctcacctgtgccatcgtccggggacagagtcgctagcgacagtgttgctttggcactgggtcaggcagtccccatcgagaggtctagaggtggcgtggggaaggacatattcatgtccaaacacggtagaataacaaattatagacaccaatctagttgagtagtcgactagaacaatacaaacgtagaacacaataccgaaacgaacctacgttacctaccccgttaggacctaacggccttacgtacccttacgtacggttccgaaccgtaccccggaagggtaccgaaccggggttagtaacgttaagttaacgttaggtacggaaacggaccggtacccccaagtaacg

SEQ ID NO: 430463 - DNA, 621 bp, Homo sapiens
  misc_feature: GZ8MTXP02JVQCJ.19.71.G05.1.454.CMB.2.raw
  modified_base (238)..(238): a, c, t, g, unknown or other
  modified_base (246)..(246): a, c, t, g, unknown or other
  modified_base (250)..(250): a, c, t, g, unknown or other
  modified_base (256)..(256): a, c, t, g, unknown or other
  modified_base (268)..(268): a, c, t, g, unknown or other
  modified_base (304)..(304): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttaanacatcaanatanaaactntagcttgacagnagacacagacacgcctcgtagctgctactattacgngggctacgtccgtaaccgggtacgtcccggggtcctacgaccgtattcgaggtcggcgaggcgggtcggtcggacgtagtacttactacctacctaccacctactacgacgacgacgccgtcgacgacggtacgtagaagtagtggtaggtacgttagtttagtttagttacgttaactaaactaaattaatttaatttaacttacgtttacgttacggttacggttaccggtaccggtaaacgggtaacggtaacggtacggtacgtaacgtacgtaacgtaacgtaacgtacggtacggtacgtacgtacgtacg

SEQ ID NO: 430464 - DNA, 621 bp, Homo sapiens
  misc_feature: GZ8MTXP02IX8TD.19.71.G05.1.454.CMB.2.raw
  modified_base (241)..(241): a, c, t, g, unknown or other
  modified_base (252)..(252): a, c, t, g, unknown or other
  modified_base (256)..(256): a, c, t, g, unknown or other
  modified_base (314)..(314): a, c, t, g, unknown or other
  modified_base (371)..(371): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgaggccgggccacatcgaactgacaagtccagccacaatctttanacactaccaanatanaaactctagcttagacagcagacgaccagacacgcctcgaggctgctactactttcgnggactacgtaccgtaccgggtagtcccggggtccccagaccgtattcgaggtcggcnggggtcgggttcgtagggactagtactttcactcctacacctatcgacgccacgccgtagacgtaggctaggaacgtgttggtacgtacgttagtttacgttagttacgtaactaaagttaatttaagtttaattaacgttaccgttacggttacggtaccggttacggaacccggtaaaggggtaaccgtagggtacgtaacttaacgtaaccgtaacgtaacggtacgtggtaccgtacgtacgtacc

SEQ ID NO: 430465 - DNA, 644 bp, Homo sapiens
  misc_feature: GZ8MTXP02HGLBX.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatccgtccggggacagagtcgctagcgacagtgttgcttggctacgtgggtcaggcaccgtacccagtacgaggtaggtacgtaagaggtcggcgtaggggaacgactaattactttacagtcgtaccaaacgtacggtaagtaaactaaacgtaattacgtcgaacctacctaattcgtaggttaggaagtacgttaccgaagtacgaaactaaacgtaaccgtaaaacggtaagaaaccaaacgtaacgtaaccggaaaactaaacccgttaacttccccgtaccgttacgacgtactacgttaccgacccttcgtacggttacgacccgttaccggaacggtaccgacgggttataataacgttagtacggtaaggaacgaccggtaccctaagtaaccg

SEQ ID NO: 430466 - DNA, 527 bp, Homo sapiens
  misc_feature: GZ8MTXP02IIGI0.19.71.G05.1.454.CMB.2.raw
  modified_base (240)..(240): a, c, t, g, unknown or other
  modified_base (315)..(315): a, c, t, g, unknown or other
  modified_base (360)..(360): a, c, t, g, unknown or other
  modified_base (374)..(374): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatctttttanacagttccaaacaatgaaaactacttagcttggtaccagcagagaccaggacagcctctaggctgctcatttacnggcatcgtacccggaatccggggtcccctgaccgattcagtggcngcggtctggggacngatttcactctcaccatcagcagccctgcaggctgaaagtatgtggctagtttattattgtacaacattaattattatactttcgtagtacgttcggactaaagggacctaaggtagtatagtaacgaagaacgtaactgtaggctaggaccc

SEQ ID NO: 430467 - DNA, 621 bp, Homo sapiens
  misc_feature: GZ8MTXP02IV157.19.71.G05.1.454.CMB.2.raw
  modified_base (242)..(242): a, c, t, g, unknown or other
  modified_base (327)..(327): a, c, t, g, unknown or other
  modified_base (391)..(391): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccatcaactgcaagtccagccacaattcttttanacagttacccaacaatagaaaactacttagcttggtaccagcagacgaccaaggacacgcctcctaggctgcctacatttaccgngggacagtacccgtaacccggggaatccccggggtacccctggacccgtattccgagtcggacngggtccgggtacgtgggacaggtactttccactctacaccatcagccagcctgcaggctaggaagtagtggtggtacttaaggttttattagttagtacctaaataaattaatttaatttacgttacgttacggttacggtacgtttacgggaaccgtaaacgggggtaacctaaggggtagaacttagtaacgaacggtaaccggtaacgtggtacggcttacgacccg

SEQ ID NO: 430468 - DNA, 585 bp, Homo sapiens
  misc_feature: GZ8MTXP02JFNOM.19.71.G05.1.454.CMB.2.raw
  modified_base (390)..(390): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctcccacaaggtgtcctgtcacaagtacagctgcagcagtcaggtccaggactggtgaacgccctcgcacgacccctctcgctcacctgtcgccatccgtccggggacagagtcgctagcgacagtgttgcttggcacgtgggtcaggcacgtccccagtcgaggaggttcagagtggcgtggggaacgactagttatttcgattcgtacccaaacgtacggtaggaaattaactaaaatttancgaccacctatctgttagagagtcgactgaacaatacaaacgtacgacacagtacgaaacgtaacctacgttcctaccgtgacgagtaccgtcgaacccttcgtacgtacgtaccgtacccggaacggtacgtaccgggttagttaacttaacgtttacgtaggttacgggaacgaccggtacccctaagtaacg

SEQ ID NO: 430469 - DNA, 677 bp, Homo sapiens
  misc_feature: GZ8MTXP02JDME2.19.71.G05.1.454.CMB.2.raw
  modified_base (234)..(234): a, c, t, g, unknown or other
  modified_base (243)..(243): a, c, t, g, unknown or other
  modified_base (254)..(254): a, c, t, g, unknown or other
  modified_base (259)..(259): a, c, t, g, unknown or other
  modified_base (315)..(315): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgaggccgggccaccatccaactgacaagtccagccaanattctttanactactacaanaatanaaactactagctagacagcagacgacagacacgcctcgagctgctactatttacgnggactacgtaccgtaccgggacgtcccgggtacccctgaccgtattcgaggtcggcgcgggtcggtcggtacgggactacgttactttccactcctaccactactacacgaccgacgtccgtacgaccgacggtacgtaggtaaacggtacgttgggtacgttacgtttaaggtttttatttacgtttaacgtaacttaaaacttaaagtttaaacttttaactttaacgtttacgtttaccgggttaacgggttaacccgggtttaaccgggaaaccggtaaacggggtaaccgtaagggttaacgtaacgttaacgtaacgtaacggtaacggtacgtaggtaccggtactacggtaccg

SEQ ID NO: 430470 - DNA, 570 bp, Homo sapiens
  misc_feature: GZ8MTXP02I3DJ8.19.71.G05.1.454.CMB.2.raw
  modified_base (241)..(241): a, c, t, g, unknown or other
  modified_base (321)..(321): a, c, t, g, unknown or other
  modified_base (406)..(406): a, c, t, g, unknown or other
  modified_base (417)..(417): a, c, t, g, unknown or other
  modified_base (419)..(419): a, c, t, g, unknown or other
  modified_base (421)..(421): a, c, t, g, unknown or other
  modified_base (428)..(428): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcaactgcaagtccagccacaattctttanacagttccaaacaatagaaaactcttagcttaggaccagcagagaccaggacagcctccgtaggcctgctctatttacgnggcagtccgtacccgggaactccccggggtccctgaccgtattcgaggtggcgaggcgggtctaggggaccagtactttcactcncaccatcagcncncncgcgagngagagagtgtgtagttagtttattagtatactaataattaatttaattattacgttacgttacggttacggttacggtaacggtaaacggaacggtaacggtagtagtaagtacgaacgtacgtacgtacgtacgtacgtcg

SEQ ID NO: 430471 - DNA, 599 bp, Homo sapiens
  misc_feature: GZ8MTXP02I9TRK.19.71.G05.1.454.CMB.2.raw
  modified_base (235)..(235): a, c, t, g, unknown or other
  modified_base (244)..(244): a, c, t, g, unknown or other
  modified_base (320)..(320): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccgatacgaactgacaagtccagccanaatctttanacagttaccaacaatagaaaactctagcttgaccagcagagaccaggactagcctccgtaggctgctcatttacgngctacgtccgtaccggacgtccggtcccagaccgtatcgaggtcggacgtgggtcggtcgtaggactagtacttcactcctacaccatcgacgcacgcctgacgagacgagaagtagttaggtagtacgttaagtttagttagttacgtaactaaactaatttaacttaagttaacgttacgttcggttaacggttaccggttaccggaaacggtaaacgggtaacgtaaggtacgtaactaagtaacgaacggtaacgtacgtgtacgcgtacgaccg

SEQ ID NO: 430472 - DNA, 591 bp, Homo sapiens
  misc_feature: GZ8MTXP02GBRQZ.19.71.G05.1.454.CMB.2.raw
  modified_base (236)..(236): a, c, t, g, unknown or other
  modified_base (245)..(245): a, c, t, g, unknown or other
  modified_base (249)..(249): a, c, t, g, unknown or other
  modified_base (254)..(254): a, c, t, g, unknown or other
  modified_base (257)..(257): a, c, t, g, unknown or other
  modified_base (304)..(304): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgatacgactgacaagtccagcacatctttanacatacaanatanaactntanctgacagacagacgacagacacgtcctcgtagctgctactattacgnggactacgtaccgtaaccgggacgtcccggggtcctacgaccgtattcgacggtcggacgacgggtcgggtcgtacgggactagtactttcaccttctacactactacacgacacgctcgacgacgacgagaagtagtgtagtacgtagttattattatactaactaattaattattattacgttacgtacggtacggttacggtacggtaaacggtaacggtaacggtacgtaacgtaacgtacgtaacgtaacgtaacgtacggtacggtacgtacgtacgtacg

SEQ ID NO: 430473 - DNA, 693 bp, Homo sapiens
  misc_feature: GZ8MTXP02HAGOZ.19.71.G05.1.454.CMB.2.raw
  modified_base (244)..(244): a, c, t, g, unknown or other
  modified_base (326)..(326): a, c, t, g, unknown or other
  modified_base (370)..(370): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacgaactgacaagtccagccacaattctttanacagttaccaaacaatgaaaactcttaagcttaggtaccagcaagagaccaaggacagcctcgtaggctgctcatttacggnggctacgtaccgtaccgggtacgtcccgggtcccctagaccgtnttcgaggtcggacgcggggtccgggtacgtacggggactagttactttccacctctaccaacctatacgacgtccacgtcccgtaggaccgtaggtacgtaaggaaacggtacgttagggtacggttacgtttaagttttacgttaacgtttacgtaaacctaaattaaacgtttaatttaacgtttaacgttacgtttacgggttaacgggttaacccggttaccgggaaccggtaaaacgggtaaccggtaaagggttacggtaaattaacgtaaccggtaacggtaaaccggttaacgtcggtacggtacgtacgtaacc

SEQ ID NO: 430474 - DNA, 502 bp, Homo sapiens
  misc_feature: GZ8MTXP02FIZQJ.19.71.G05.1.454.CMB.2.raw
  modified_base (236)..(236): a, c, t, g, unknown or other
  modified_base (311)..(311): a, c, t, g, unknown or other
  modified_base (355)..(355): a, c, t, g, unknown or other
  modified_base (427)..(427): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttacngggcatctaccgggaatccggggtcccctgaccgattcagtgcngcgggtctgggacagatttcactctcaccatcagcagcctgcaggctgaagatgtggcagtttatattgtanaaacaattatattatacttcgtgtacgttcggactaagggaccaaggtgattagcaagacgaactgtaggctgac

SEQ ID NO: 430475 - DNA, 594 bp, Homo sapiens
  misc_feature: GZ8MTXP02FZTAW.19.71.G05.1.454.CMB.2.raw
  modified_base (398)..(398): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcgttggcacgtgggtcaggccacgtccccagtccggagagggttctaggaggtgggcgtaggggaacggactagttatttcgattcgtccaaacgacggtaggaaaattaacgtaaatttancgtacaaccctattcgtgttagaagtagtccgaatcgaacaaatacgaaacgtaagacaacaagtacgaaacgtaacctacgttcctacctgactaggactacgacctctcggtacgtacccgtaccggaacggaccgtaacgggtagttaagtaacgttacgtaggtacggaacgtaccggacccctaagtaacg

SEQ ID NO: 430476 - DNA, 583 bp, Homo sapiens
  misc_feature: GZ8MTXP02FRC8F.19.71.G05.1.454.CMB.2.raw
  modified_base (474)..(474): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatcgtccggggacagagtcgctagcgacagtgttgcttggcacgtgggtcaggcacgtccccatcgagaggtctaggagtggctaggggaagtacagttactttcacttgtcccaaacgacggtagaaataactaaaatttatcgacacctaattcgttagttagagtacgtccgaattagaacaaatacgaaacgtagaacacaagtacgaaacgtaaccacgttcctcccngtacgacgtctacgaccttcgtacgtacgtaccgtacccggaacggaccgtacgggttattaacgtaacgtttacgtggttacggaacgaccggacccctaagtaaacg

SEQ ID NO: 430477 - DNA, 707 bp, Homo sapiens
  misc_feature: GZ8MTXP02GBF0T.19.71.G05.1.454.CMB.2.raw
  modified_base (238)..(238): a, c, t, g, unknown or other
  modified_base (302)..(302): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccactattctttanactacgttaccaaactaatagaaaactacttagtcttaggaccagacagacgaccgaggacacncctacgaggctgccttatacgtttacgcggacttacgtacccggtaaccgggaacggttccccggggtacccctacggaccgttattaccgaggttcggacgacggggtccgggttacgtacgggggaacctaggtttaactttccaacttccttaccaaacccgttgtacgacgccgacgtccgtaggacgtaggtacgtaaggaacgttagttcggttacggtacgtttaaagttttacgtttacgttacgtaaacttaaactttaaagttttactttaacgtttacgttacggttacgggttacggttaccggtaaccgggaaaccggtaaacgggtaacgtaagggtacgtaataacgaacggtaaacgtaaccggtacggttggtacggtacgtacgacg

SEQ ID NO: 430478 - DNA, 635 bp, Homo sapiens
  misc_feature: GZ8MTXP02IJYO0.19.71.G05.1.454.CMB.2.raw
  modified_base (239)..(239): a, c, t, g, unknown or other
  modified_base (249)..(249): a, c, t, g, unknown or other
  modified_base (253)..(253): a, c, t, g, unknown or other
  modified_base (269)..(269): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccacaatctttanacactacaanatanaaactatagctgacancagacacgagacacgcctcgagctgctactatttacgtggctacgtaccgtaccggtacgtccggggtcccctacgaccgtacgttacgaggtcggacgtacggggtccggtacgtacggggactagtactttcaccttctacaacctactacgacgacgacgtcctacgacgtacgacgtagaagtacgtacggtcggtacgttacgtttacgtttacgttacgttaactaaactaacttaactttaatttaacgttacgttacggttacggttacggttaccggtaacggtaaacggtaacggtaacggtacggtaacgtaacgtaacgtaacgtaacgtacgtacgtacggtacgtacgtacg

SEQ ID NO: 430479 - DNA, 544 bp, Homo sapiens
  misc_feature: GZ8MTXP02F4S0I.19.71.G05.1.454.CMB.2.raw
  modified_base (231)..(231): a, c, t, g, unknown or other
  modified_base (241)..(241): a, c, t, g, unknown or other
  modified_base (245)..(245): a, c, t, g, unknown or other
  modified_base (251)..(251): a, c, t, g, unknown or other
  modified_base (254)..(254): a, c, t, g, unknown or other
  modified_base (300)..(300): a, c, t, g, unknown or other
  modified_base (399)..(399): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccaggggacatcgtgatgacccagtctccagactccctggctgtgtctctgggcagcgggccacatcaactgcaagtccagccacaatctttanacataccaanatanaaactntanctagacagcagacgacagacacgcctcgtaggctgctatattacgnggactacgtaccgtacccgggagtcccggggtcctacgaccgtatcgaggtcggacgaggtcgggtcgaggactagtattcactcacacatcacacacnctcacgagcgtagagagtgtgtagtagtttattattagtactaactaattaattaattattacgttacgtacgtacggtacggtacgaacggtaacggtaacggtagacgtatacgaagacgtaacgtacgtagcgtcgactacg

SEQ ID NO: 430480 - DNA, 723 bp, Homo sapiens
  misc_feature: GZ8MTXP02HG6ER.19.71.G05.1.454.CMB.2.raw
  modified_base (231)..(231): a, c, t, g, unknown or other
  modified_base (243)..(243): a, c, t, g, unknown or other
  modified_base (261)..(261): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccgatcaactgacaagtccagccanaattcttttaanactacttaccaacaatanaaaactactagtcttacgacagcagacgacgagacacgcctactaggctgctactactttacgcggactacgtaccgtaacccgggtacgtcccgggtaccccctacgaccgtactacgaggtcggacgcggggtccgggtacgtacggggaactagttactttaccaacccgttacctacccaaccctactaccgacgaccgacgtcccgtagaccgtacgggacgtaaggtaaagtacggttgggtacggtacgtttaaggtttttaacgtttacgttacgtaaacctaaaacgttaaatttaaacgttttaacgtttaaacgtttaacgtttaccgggttaacgggttaacccggtttaccgggaaacccggtaaaacggggtaaccggtaaaggggttacggtaacttaacgtaacgtaaacggtaacgtaacggttacggtacggtaccgtacgacc

SEQ ID NO: 430481 - DNA, 633 bp, Homo sapiens
  misc_feature: GZ8MTXP02GH61K.19.71.G05.1.454.CMB.2.raw
  modified_base (228)..(228): a, c, t, g, unknown or other
  modified_base (236)..(236): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (304)..(304): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccacgatacgactgacaagtccagccanatctttanacatacaanatanaaactntanctagacagcagacgacagacacgcctacgagctgctactattacgnggactacgtaccgtaacccgggacgtccccggggtacctacggtaccgtagttcgacggtcggacgacgggtccggggtacgtacggggaactagtactttacacttcctaccaactactacacgacgacgtcgtacgacgacggacgtagaagtagtaggtacggtacgttagtttagtttagttacgtactaaactaaattaatttaacttacttacgttacggttacggtacggtaccggtaaccggtaaacgggtaacggtaacggtacggtaacgtacgtacgtaacgtaacgtaacgtacggtacggtacgtacgtacgtacg

SEQ ID NO: 430482 - DNA, 550 bp, Homo sapiens
  misc_feature: GZ8MTXP02GGPST.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgtgcttggcacgtgggtcaggcacgtccccatcggagaggtctaggagtggcgtggggaacgactattattcatcgtaccacgacgtaggaatactaaattatgacacctattctgttagagtagtacgacgtagaacaatacaaacgtagaacaacataacgaaagtacctagttccaccgtgctacgctacgactcgtcgtacgaccgtccggacggtacgtacgggttagtacttaagttaacgtcggtacggaacggtaccgaccctagacgtaacg

SEQ ID NO: 430483 - DNA, 555 bp, Homo sapiens
  misc_feature: GZ8MTXP02IKZX4.19.71.G05.1.454.CMB.2.raw
  modified_base (232)..(232): a, c, t, g, unknown or other
  modified_base (245)..(245): a, c, t, g, unknown or other
  modified_base (256)..(256): a, c, t, g, unknown or other
  modified_base (308)..(308): a, c, t, g, unknown or other
  modified_base (359)..(359): a, c, t, g, unknown or other
  modified_base (366)..(366): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctcagactccctggctgtgtctctgggcgagcgggccacatcaactgcaagtccagccacaattctttanacagttaccaaanaatgaaaactntagcttggacagcagagaccaggacagcctccgtaggctgctacatttacgnggctatccgtacccgggaatccccggggtcccctgaccgtattcgagtgcnggcggtntcgggactagtactttcactctcacctatcagcagccctagcgaacggctaggaaagtcgtggtaggtacttaagttttataagttgtaacaaattattaattattaatacgttcgtacgtacgttacgacgtaaagggacctaggtagactaagtaacgaagtaccgtaaagtgcggtactacgaacc

SEQ ID NO: 430484 - DNA, 527 bp, Homo sapiens
  misc_feature: GZ8MTXP02JXDWN.19.71.G05.1.454.CMB.2.raw
  modified_base (237)..(237): a, c, t, g, unknown or other
  modified_base (248)..(248): a, c, t, g, unknown or other
  modified_base (312)..(312): a, c, t, g, unknown or other
  modified_base (423)..(423): a, c, t, g, unknown or other
  modified_base (426)..(426): a, c, t, g, unknown or other
  modified_base (439)..(439): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacttcctggctgtgtctctgggcgagcgggccacatcaactgcaagtccagccacaatcttttanacagttccaanaatagaaaactacttagcttggtaccagcagagaccaggacagcctcctaggctgctcatttcngggcatccgtaacccgggaatcccggggtccccctggacccgattcagtcggcaggtcgggtctggggacagtatttccatctcaccatcagcagcctgcaggctagaagntgngatagtttatatntacaataattattattatacgtgtacggtacgtcggacgaaggacgtaaggtcgaatagaagaacgtacgtacgtgcggactacgacc

SEQ ID NO: 430485 - DNA, 605 bp, Homo sapiens
  misc_feature: GZ8MTXP02FO4DH.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatccgtccggggacagagtcgctagcgacagtgttgcttggcacgtgggtcaggcacgtccccagtcgagaggtctagaggtggcgtaggggaagactagtatttcgattcgtccaaacgtacggtaggaaataacgaaattatcgacactatctagttagagagtcgatagacaatacgaaacgtacgaacaacgataccgaaaagtaacctaacgttcctacccgtagacgaacgtccgtacgtacccttacgtcggttaccgaaccgttaccccggaacgggtaaccgtaaccggggttagttaacgttaacgtttaccgtaggttacggggaaacggtacccgggaccccctaagtaaaccgg

SEQ ID NO: 430486 - DNA, 537 bp, Homo sapiens
  misc_feature: GZ8MTXP02JSX0Q.19.71.G05.1.454.CMB.2.raw
  modified_base (243)..(243): a, c, t, g, unknown or other
  modified_base (323)..(323): a, c, t, g, unknown or other
  modified_base (434)..(434): a, c, t, g, unknown or other
  modified_base (458)..(458): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatcaactgacaagtccagccaactaattctttanacagttaccaaacaatagaaaacttactagcttggtaccagcagagaccaggacagcctcgtaggctgctctatttacgnggacataccgaaccgggactcccccggggtccctagaccgtattcgaggtgcgagcgggtctgggacagtacttcactctacaccatcagcacgcctgccgagctagaagngtgtggattagtttatatacgtanaaatatattattatacgttgtacgtacgttcggaccgaaggtacgaaggtgaataagacaagacgtagtagcggtcacg

SEQ ID NO: 430487 - DNA, 608 bp, Homo sapiens
  misc_feature: GZ8MTXP02GZ01O.19.71.G05.1.454.CMB.2.raw
  modified_base (240)..(240): a, c, t, g, unknown or other
  modified_base (285)..(285): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctctgggcgagcgggccaccatcaactgcaagtccagccacaattctttanacagttccaaacaatagaaaactcttagcttaggtaccagcaganaccaggacagcctcaggctgctctatttacgnggctactccgtaaccccggggattcccggggtcccccctggacccgtattcgaggtggcgagggtcggggtctggggaccaggtactttcgacttcctcacccatcagctacgccctgcgaggcgtagaaagtgtggtaggtcttaagttttagttattacgtactaaactaattatttaattactacgttcggtaggtaccgtttcggacccgtaaaaggggtacctaaggggtacggtaattacgtaacgaaacggtaacgtaaacgttggacggtactacggaacccg

SEQ ID NO: 430488 - DNA, 625 bp, Homo sapiens
  misc_feature: GZ8MTXP02H0T11.19.71.G05.1.454.CMB.2.raw
  modified_base (234)..(234): a, c, t, g, unknown or other
  modified_base (306)..(306): a, c, t, g, unknown or other
  modified_base (333)..(333): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacatgaaaactctagcttggtaccagcagagaccaggacagcctctaggctgctcatttacgnggcatccgtaccggacgtccgggtccncgaccgtattcgagtgcagggcgggtcgtagggactagtacttcactcctacactatcacgcacgtccgtgcgaggtcgtagaagtgtggtacgtacgtttaagtttattagttacgtaactaaactaaagtttaatttaagtttaaccttacgtttacgggttacgggttaaccggtttaccgggaaaccggtaaaacggggtaaccggtaaaggggttacggtaaacgttaacgtaccgtaaaacggtaaccggtaaacgttcggtacggtaccgttacgtaccctaacg

SEQ ID NO: 430489 - DNA, 619 bp, Homo sapiens
  misc_feature: GZ8MTXP02HHK1E.19.71.G05.1.454.CMB.2.raw
  modified_base (316)..(316): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagacgtcgctagcgacagtgtgcgttggcacgtgggtcaggcacgtccccatcgagagtcagngtggcgtaggggagactatatttcagttcgaccaacgtacgtaggaataacgtaaattatcgactaccattctaggttagagacgttcgaacttacgaactatacaaacgtagaccaacgataacgaaagaccctaagttccctaccctagaccgtaacgtcgtacgtaacccgttcgtacggtaccgtaacccgttacccgggaacgggtaacccgtacgggggtttacgtttaaacttaacggtttaaccggtaggggttaacggaaaaccggtaccccggacccccgtaaattaacccgg

SEQ ID NO: 430490 - DNA, 532 bp, Homo sapiens
  misc_feature: GZ8MTXP02G3AAU.19.71.G05.1.454.CMB.2.raw
  modified_base (239)..(239): a, c, t, g, unknown or other
  modified_base (368)..(368): a, c, t, g, unknown or other
  modified_base (375)..(375): a, c, t, g, unknown or other
  modified_base (421)..(421): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaattctttanacagttaccaacaatagaaaactacttagcttaggtaccagcagagaccaggacagcctctagctgctcatttacgtggacacgtccgtacccgggaatccggggtccccctgaccgtattcagtggcnggcggtntgggacagtattcactctcaccatcagcagcctgcagctagaaagntgtggtctagtttatagttgtactaactaatattattatacttcgtagtacgttcggacgtaagggacctaaggtcgatacgtaacgaagacgaacgtgtcggactagacc

SEQ ID NO: 430491 - DNA, 568 bp, Homo sapiens
  misc_feature: GZ8MTXP02IG995.19.71.G05.1.454.CMB.2.raw
  modified_base (245)..(245): a, c, t, g, unknown or other
  modified_base (319)..(319): a, c, t, g, unknown or other
  modified_base (436)..(436): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacgatacgaactgactaagtccagccactaattcttttanacagttaccaacaatagaaactactagcttaggaccagcagacgacaggacagcctccagctgctcatttacgnggcatccgtacccgggaatccggggtcccctgacccgtattcgaggtcgcaggcgggtactggggacctagtactttacacgtctacacctatcagcacgcctgacagtcagaaagntgcggtatagtttattattgtaacaaactaattaatttataacttacgtttacgtacggtacgttcggactaaaggggacctaagggtacgtaatactaacgaagaacgtaacgtagtacggcctagaaccc

SEQ ID NO: 430492 - DNA, 500 bp, Homo sapiens
  misc_feature: GZ8MTXP02IJF7U.19.71.G05.1.454.CMB.2.raw
  modified_base (421)..(421): a, c, t, g, unknown or other
tcagtactctcgtgcacgaccggtgctcgatttagtgtcgtcgcaagagagagggggcagagtctgctgaattctggctgaccagggcagtcaccagagctccagaaaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcactgggtcaggcagtccccatcgagaggtctagagtggctgggaacgacatatttcatgtccagcgtggaaatacaaattatgacaccatctgtgagagtcgactgacaatacaacgtagacacatacgaagaccagtctacccngtcagctgactctcgtcgacctccggaggacgacgggtactatattaacgtgtacggacgacggacccctagtacgaac

SEQ ID NO: 430493 - DNA, 547 bp, Homo sapiens
  misc_feature: GZ8MTXP02I0Y64.19.71.G05.1.454.CMB.2.raw
  modified_base (237)..(237): a, c, t, g, unknown or other
  modified_base (314)..(314): a, c, t, g, unknown or other
  modified_base (353)..(353): a, c, t, g, unknown or other
  modified_base (364)..(364): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaacaatagaaaactacttagcttaggtaccagcagagaccaggacagcctctaggctgctcatttacngggcatcgtacccgggaatcccggggtcccctgaccctnttcagtcggcnggcgggtctgggacagtatttcactctcaccatcagcagcctgcacggctagaaagagttgtggtctaggtttattatgtacaaactaattaattattatacgttcgtacggtacgttacggaccgtaaagggacctaaagggtcgaagtataacgaagacgtaactggtacgcgtacgaccg

SEQ ID NO: 430494 - DNA, 608 bp, Homo sapiens
  misc_feature: GZ8MTXP02I9A5Q.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagacgtcgctagcgacaggtgtgcttggcacgtgggtcaggcagtccccatcgagagtcagagtggctgggaagacagtatttcattgtccaacacgtagaaatacaaattatagacaccatctgttagagagtcgactagaactatacaaacgtagacaactaatacgaaagaaacccgtacgttaccgtacccttacggacctacggtacctacgtaacccgttcgttacgttaccgacccgttacccgggaacgggtaaccgtacccgggggtttaagttaaacgttaacgtttaaccgtacgggttaacggggtaaaccggtaacccgggacccccctaaaggtaaacccgg

SEQ ID NO: 430495 - DNA, 597 bp, Homo sapiens
  misc_feature: GZ8MTXP02IKO76.19.71.G05.1.454.CMB.2.raw
  modified_base (242)..(242): a, c, t, g, unknown or other
  modified_base (321)..(321): a, c, t, g, unknown or other
  modified_base (366)..(366): a, c, t, g, unknown or other
  modified_base (379)..(379): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaagtccagccacaattctttanacagttaccaaacaatagaaactactagcttaggtaccagacagacgaccaggacagcctcaggctgctctatttacgnggacagtccgtacccggggtaactcccggggtcccccagaccgtnttcgaggtcggcngggcgggtactaggggactagtctttcactctcacatcagcacgcctgcaggctagaacgtagtggtagtcttagtttattagttacgtaacaaactaaattattaattattacgtttacgtacggtaccggtttacggaaccgtaaacgggtaaccgtaagggtacgtaagtaagtaacgaaacggacgtaaacgttggtaacggcttacggaaccc

SEQ ID NO: 430496 - DNA, 546 bp, Homo sapiens
  misc_feature: GZ8MTXP02GQAKJ.19.71.G05.1.454.CMB.2.raw
  modified_base (381)..(381): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccggggacagagtcgctagcgacagtgttgcttggcacgtgggtcaggcacgtccccatcgagaggtctagagtggcgtaggggaaggactattactttcattcgtccaaactacggtaggaaataactaaatttangacactatctgttagagtagtcgatagaacaatacaaacgtagacacatacgaaacgtaacctacgttcctaccgtgacacgctacgacctctcgacgacctccggacggacgtacggtataactaagttacgtaggtacggtaacgaccggtacccagtaaccg

SEQ ID NO: 430497 - DNA, 554 bp, Homo sapiens
  misc_feature: GZ8MTXP02GJGCJ.19.71.G05.1.454.CMB.2.raw
  modified_base (237)..(237): a, c, t, g, unknown or other
  modified_base (301)..(301): a, c, t, g, unknown or other
  modified_base (309)..(309): a, c, t, g, unknown or other
  modified_base (358)..(358): a, c, t, g, unknown or other
  modified_base (390)..(390): a, c, t, g, unknown or other
  modified_base (394)..(394): a, c, t, g, unknown or other
  modified_base (397)..(398): a, c, t, g, unknown or other
  modified_base (400)..(400): a, c, t, g, unknown or other
  modified_base (404)..(404): a, c, t, g, unknown or other
  modified_base (416)..(416): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccacaatcttttanacagttccaacaatgaaaactctagcttggaccagcagagaccaggacagcctctaggctgctnatttacgnggcatctacgtcgggacgtccgggtcccctgaccgtattcgaggtggcngggtcgggtcgtagggacagtactttcactcncacntcnncncgcngcgagcagagtntggtgtattagttattatagtactaataattattattacttacgttcggtacggtaccggttacggaacggtaaagggaccgtaagggtacgtaatacgtaacgaacggtaacgtacgttacggtacggccgtacgac

SEQ ID NO: 430498 - DNA, 577 bp, Homo sapiens
  misc_feature: GZ8MTXP02FG009.19.71.G05.1.454.CMB.2.raw
  modified_base (239)..(239): a, c, t, g, unknown or other
  modified_base (311)..(311): a, c, t, g, unknown or other
  modified_base (353)..(353): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcacgatacgaactgacaagtccagccacaatctttanacagttcaacaatgaaaactacttagcttggaccagcagagaccagacagcctctaggctgctcatttacgnggcactcgaccggacgtccggtccccagactatcgagtgcgngcgggtgtagggacagtacttcactcacaccatacacgacgacgccgtcgacgacgacgtagaaagagtagtacggtacgttaagtttaagtttagttacgtaactaaactaaattaattaattaagttacgttacgtacggtacggttacggtacgtaaacggaacgtaacggtaacggtaagtaagtaacgaacgaacgtaacgtagtacgtacgtacgacg

SEQ ID NO: 430499 - DNA, 582 bp, Homo sapiens
  misc_feature: GZ8MTXP02F5B5Q.19.71.G05.1.454.CMB.2.raw
  modified_base (572)..(572): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtcgctagcgacagtgttgcttggcacgtggtcaggcacgtccccatcgagaggtctagagtggcgtagggaagactagttatttcattcgtaccaacgtacgtaggaaactactaaattatcgacaccattctgttagagagtcgaactagaacaatacaaacgtaagaacaacaagtacgaaacgaacctagttccctaccgtcgacacgctacgtacctctacgtacgacccgtaccggacggtacgtacggttataagttacttacgtaggtaggaaacggtaccggaccccaagtacgacacgtacgaaccctacctcgtcgtaccgtggtacncgtttaaacg

SEQ ID NO: 430500 - DNA, 516 bp, Homo sapiens
  misc_feature: GZ8MTXP02HEIW9.19.71.G05.1.454.CMB.2.raw
  modified_base (345)..(345): a, c, t, g, unknown or other
  modified_base (364)..(364): a, c, t, g, unknown or other
  modified_base (406)..(406): a, c, t, g, unknown or other
  modified_base (425)..(425): a, c, t, g, unknown or other
  modified_base (476)..(476): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctaggagtggcgtgggaacggacatatttcatgtaccacncgtaggaatacgaaattangcaccatctgttgagagtcgatagacaatacaacgtagacanatacgaagacctagttccnccctgacagctcgacctcgtacgtacgaccgtcccggaggacgtacgggtntattactcgtgtacggaacgtaccggccccaagtacggac

SEQ ID NO: 430501 - DNA, 650 bp, Homo sapiens
  misc_feature: GZ8MTXP02JBZAQ.19.71.G05.1.454.CMB.2.raw
  modified_base (242)..(242): a, c, t, g, unknown or other
  modified_base (319)..(319): a, c, t, g, unknown or other
  modified_base (349)..(349): a, c, t, g, unknown or other
  modified_base (367)..(367): a, c, t, g, unknown or other
  modified_base (630)..(630): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccatcaactgcaagtccagccacaattcttttanacagttccaacaatagaaaactactagcttagtaccagcagacgaccaggacagcctcctaggctgctcatttacgnggcatccgtacccgggatccggggtccccngaccgattccagtcggcngggtcgggtcgtgggacagtactttaccacttcctacaaccctactacgaacgccgacgccctgacccgaggtacgtaacgaaaaggtcgttgggttaacggtaccgttaaaggtttttactttaacttagtaaacctaaaagttaaagtttaaacttttatttaacgttaacgtttacggttaacgggttaccggtttaccggaaccggtaaaacgggtaaaccgtaaggggtacggaattaccgaagtaacgaacgtacgnggttacggacgtcgaacccg

SEQ ID NO: 430502 - DNA, 510 bp, Homo sapiens
  misc_feature: GZ8MTXP02JG4N1.19.71.G05.1.454.CMB.2.raw
  modified_base (328)..(328): a, c, t, g, unknown or other
  modified_base (357)..(357): a, c, t, g, unknown or other
  modified_base (421)..(421): a, c, t, g, unknown or other
  modified_base (424)..(424): a, c, t, g, unknown or other
  modified_base (453)..(453): a, c, t, g, unknown or other
  modified_base (474)..(474): a, c, t, g, unknown or other
  modified_base (505)..(510): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttactgggcatctacccgggatccggggtcctgaccgattcagtggcaggcgggtctgggacagatttcactctcacatcagcagcctgcaggctgaagntgtggctagtttatatgtacaaataattnttattatacttcgtaggtacgttcggacgaaacggggactaagggtgaatatcgagacgaatgngcngacactatctgtacttcacttcgttcccnctatctagaccagatcgtacnggacgcggctggaccgaaggccgaagagagnnnnnn

SEQ ID NO: 430503 - DNA, 481 bp, Homo sapiens
  misc_feature: GZ8MTXP02HFQV2.19.71.G05.1.454.CMB.2.raw
  modified_base (239)..(239): a, c, t, g, unknown or other
  modified_base (246)..(246): a, c, t, g, unknown or other
  modified_base (255)..(255): a, c, t, g, unknown or other
  modified_base (257)..(257): a, c, t, g, unknown or other
  modified_base (259)..(259): a, c, t, g, unknown or other
  modified_base (269)..(269): a, c, t, g, unknown or other
  modified_base (275)..(276): a, c, t, g, unknown or other
  modified_base (296)..(298): a, c, t, g, unknown or other
  modified_base (300)..(300): a, c, t, g, unknown or other
  modified_base (305)..(305): a, c, t, g, unknown or other
  modified_base (307)..(307): a, c, t, g, unknown or other
  modified_base (309)..(309): a, c, t, g, unknown or other
  modified_base (328)..(328): a, c, t, g, unknown or other
  modified_base (331)..(331): a, c, t, g, unknown or other
  modified_base (333)..(333): a, c, t, g, unknown or other
  modified_base (335)..(335): a, c, t, g, unknown or other
  modified_base (337)..(337): a, c, t, g, unknown or other
  modified_base (341)..(341): a, c, t, g, unknown or other
  modified_base (343)..(343): a, c, t, g, unknown or other
  modified_base (348)..(348): a, c, t, g, unknown or other
  modified_base (351)..(351): a, c, t, g, unknown or other
  modified_base (361)..(361): a, c, t, g, unknown or other
  modified_base (364)..(364): a, c, t, g, unknown or other
  modified_base (367)..(367): a, c, t, g, unknown or other
  modified_base (369)..(369): a, c, t, g, unknown or other
  modified_base (371)..(371): a, c, t, g, unknown or other
  modified_base (376)..(376): a, c, t, g, unknown or other
  modified_base (378)..(378): a, c, t, g, unknown or other
  modified_base (391)..(391): a, c, t, g, unknown or other
  modified_base (455)..(455): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggcctcggactaaggaccgtcgagtaaggcagccanatcttanacatacaanananaactactatntgacannagagacgagacacgctcagnnntntatgngncncgacgtacgtcgccgcgcntgngngngngcgngngagantanctctcacacncanacncncncgcgngntagagagtgtgtntatatatagtatatatattatatacgtcgtacgtacgtacgtacgtacgacgagtacgtagtanaagacgacgtacgtgtcgtcgactac

SEQ ID NO: 430504 - DNA, 549 bp, Homo sapiens
  misc_feature: GZ8MTXP02HYLZF.19.71.G05.1.454.CMB.2.raw
  modified_base (243)..(243): a, c, t, g, unknown or other
  modified_base (320)..(320): a, c, t, g, unknown or other
  modified_base (440)..(440): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccaacaattcttttaanacagttaccaaacaatagaaaactacttagcttaggtaccagcagagaccaggacagcctcaggctgctcatttacngggcacgtccgtaaccccggggaatcccggggtcccctgacccgtattccgagtcggcagggtcgggtctaggggactaggtactttcactctcaccatcagcagcctgcagctagaagntgtggattagtttatatgacaaatatattattatacttcgtacggtacgttacggactaaagggacctaaggtacgaatacgtcgaagtaccaacgtgtacgctagacc

SEQ ID NO: 430505 - DNA, 594 bp, Homo sapiens
  misc_feature: GZ8MTXP02FNVRU.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcagtccccatcgagaggtctagagtggcgtaggggaaggcagttatttcattcgtaccaaagacgttggaaacttaacaaattatgacaccatcgtgtagagagtcgactgaacaatcgaaacgtagacaacatacgaaagaacctagttccacctgacaagctacgaccttctggtacgacccgtaccggagtaaccgtacggggttataacgttacgttaccgtagggttacgggaaacgacccgggaccccctaagttacggaacctacgtccgaaccctacccgttacgttccgttcggtacggtacggtacctttaaacggg

SEQ ID NO: 430506 - DNA, 671 bp, Homo sapiens
  misc_feature: GZ8MTXP02G5S8T.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctaggagtggcgtaggggaacggactagttatttcgattcggtacccaacgtacggttagggaaaacttaaccgtaaaatttagtacgaccctaaccctattccgttaggttacggaagtacgtacgacgtagaacaaagtacgaaacgtaagaacctaacgaacgttaccgaaacgtaaccctacgtttaccctacccgtacgacgtaacgtccgtacggtaacccttcggtacggtaccgtacccgttacccccgggaaagggtacccgtaaccgggggttacgttaacgtttaacgtttaaccggtaggttaacggggaaaccggtaacccggtaccccctaaaggttaaccgtaaccg

SEQ ID NO: 430507 - DNA, 529 bp, Homo sapiens
  misc_feature: GZ8MTXP02IQCM7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcattcaggtccaggactggtgaagccctcgcagacccctctcgctcacctgtgccatctccggggacagagtcgctagcgacagtgttgcgttggcacgtgggtcgaggcagtccccatcgagaggtctagagtggcgtagggaaggacagtatttcattgtccaaacacggtaggaaataacaaattatagacacatctgttgagtagtcgactgacaatacaaacgtagaacacatacgaacgaaaccgtacgttcctacctgacagctgacctctcgtgacctacccggaggtacgacgggtatagtaagttacgtggtacggaacgacggccccaagtacg

SEQ ID NO: 430508 - DNA, 589 bp, Homo sapiens
  misc_feature: GZ8MTXP02FQQYQ.19.71.G05.1.454.CMB.2.raw
  modified_base (237)..(237): a, c, t, g, unknown or other
  modified_base (315)..(315): a, c, t, g, unknown or other
  modified_base (362)..(362): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaacaatgaaaactacttagcttggtaccagcaagagaccaggacagcctcctaggctgctcatttacgnggcatccgaccggagtccgggtcccctagacctattcgagtcggcgngggcgggtcgtggacagtactttcacttcacaccatacagcacgcctgacgacgacgtagaagtagtagtggtacgttagtttagtttattacgtactaaactaaattaattaattaacttacgttacgttacggtacggttacggtaccggtaaacgggtaaacggtaacggtacggtaagtaacgtaacgtaacgaacgtaacgtacggtacgtacgtacgtacg

SEQ ID NO: 430509 - DNA, 573 bp, Homo sapiens
  misc_feature: GZ8MTXP02IBQBS.19.71.G05.1.454.CMB.2.raw
  modified_base (372)..(372): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatctccggggacagagtcgctagcgacagtgttgcttggcacgtgggtcaggcacgtccccatcgagaggtctagagtggcgtggggaagacattatttcattcgtccaaacgacgtaggaaatacaaattangacacctatctagttgagtacgtcgactacgaacaactacgtaaacgtaacgacaacgatacgaaacgaaacctacgttacctcccgtagacacgtactacgacccttcgtcgtaccgaccgtacccggaacggaccgtacggggtacgttaacgtaacgttacgtaggtacggaacggtaccggacccccgaagtaaccg

SEQ ID NO: 430510 - DNA, 643 bp, Homo sapiens
  misc_feature: GZ8MTXP02GP8IZ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtccgctagcgacagtgtgcgttggcacgtgggtcaggcacgtccccagtcgagaggtctagagtggcgtgggaagactatattcaattcgtaccaaacgtacgtaggaaataactaaaatttatacgacctaacctattcgtagtttgaagtacgtcgtaactacgaaactaaacgtacaaaaccggttaagaaacaacgtaacgtaccgaaaacggtaaacctaacgtttaccctacccgttagtaccgacgtacccgttacgtaacccttcgtacgtaccgtacccgttacccggaacgggaaccgtaacgggggttactttaaacgttaacgttaaccggttagtaacggggaaaccgtaccggaccccctaagtaaacccgg

SEQ ID NO: 430511 - DNA, 555 bp, Homo sapiens
  misc_feature: GZ8MTXP02H94BF.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagtgttgcttggctacgtgggtcaggcagtccccatcgagaggtctagagtggcgtggggaagactatatttcattcgtccaaacgtacgtaggaaataacaaaatttatcgaccaccattcgtgttagagtagtcgactgaactatacaaacgtagacacatacgaaagacctagttccaccctgacacgctacgacctcgtgtacgaccgtcccggaaaggaccgtacggggttataacgttaacgttacgtaggtacgggaaacgacccgggtaccccaaagtaccg

SEQ ID NO: 430512 - DNA, 506 bp, Homo sapiens
  misc_feature: GZ8MTXP02GW4GM.19.71.G05.1.454.CMB.2.raw
  modified_base (347)..(347): a, c, t, g, unknown or other
  modified_base (445)..(445): a, c, t, g, unknown or other
  modified_base (471)..(471): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcattcaggtccaggactggtgaagccctcgcagacccctctcgctcacctgtgccatctccggggacaggagtcgctagcgacagtgttgcttggcactgggtcaggcagtccccagtcgagaggtcagagtggctgggaaggacagtatttcattgtccaanacgtgaatacaaatatgcacatctgttgagagtcgatgaacaatcgaaagtagaacacgatacgaagaaaccagttcctaccctgactagctgactcngtcgactccgaggtacaacggggttntagtaagtacgagtacgacgaccgaccctagtacg

SEQ ID NO: 430513 - DNA, 580 bp, Homo sapiens
  misc_feature: GZ8MTXP02JWKD7.19.71.G05.1.454.CMB.2.raw
  modified_base (241)..(241): a, c, t, g, unknown or other
  modified_base (317)..(317): a, c, t, g, unknown or other
  modified_base (363)..(363): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacaactgacaagtccagacacaatcttttanacagttaccaacaatagaaactactagcttaggaccagcagagaccaggacagcctcgtagctgctctatttacgnggcacgtaccgtaccggacgtccggtcccagacgtatcgagtcgcnggtcgggtcgaggacagtacttacactcacacatcacgcacgctgacgagtactagaagtgtaggtagtacgttagtttattagtacgtaactaaataattaatttattaacgtacgttacggtacggtaccggtacggaaccgtaaacgggtaacgtaagggtacgtaacgtacgtaacgtaacgtaacgtacgtacggtacggtacgtacgaccg

SEQ ID NO: 430514 - DNA, 615 bp, Homo sapiens
  misc_feature: GZ8MTXP02F1Z31.19.71.G05.1.454.CMB.2.raw
  modified_base (238)..(238): a, c, t, g, unknown or other
  modified_base (251)..(251): a, c, t, g, unknown or other
  modified_base (260)..(260): a, c, t, g, unknown or other
  modified_base (304)..(304): a, c, t, g, unknown or other
  modified_base (360)..(360): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcctggctgtgtctctgggcgagcgggccacgatacgaactgacaagtccagccacaatctttanacatacaacatanaaactatanctagacagcagacgacagacagcctcgagctgctctatttacgnggactagtaccgtaaccgggtaacgtccggggtccccagaccgtatcaggtgacgnggtcgggtcgtagggaactagtactttcacttctacaaccatacacgacacgacctacgacgacgacgtacgaaagtagtaggtacggtacgttagtttaagtttaagttacgttaactaaactaaattaaatttaattaacgttaacgttacgttacggttacggttacggtacggtaaacggtaaacgtaaacggtaacggtaagtaacgtaacgtaacgtaacgtaaacgtacggtacggtacgtacgtacg

SEQ ID NO: 430515 - DNA, 585 bp, Homo sapiens
  misc_feature: GZ8MTXP02FOHH1.19.71.G05.1.454.CMB.2.raw
  modified_base (229)..(229): a, c, t, g, unknown or other
  modified_base (238)..(238): a, c, t, g, unknown or other
  modified_base (250)..(250): a, c, t, g, unknown or other
  modified_base (289)..(289): a, c, t, g, unknown or other
  modified_base (303)..(303): a, c, t, g, unknown or other
  modified_base (310)..(310): a, c, t, g, unknown or other
  modified_base (349)..(349): a, c, t, g, unknown or other
  modified_base (373)..(373): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcgaactgacaagtccagccanaatctttanacagttaccaanaatagaaactactagcttggtaccagcagagaccagacngcctctagctgctnatttacngggcatcctaccgggaatcccggggtcctcgaccgtatnagtgcaggcgggtctgggacagtntttcacctctacaccatacagcacgccctgacgacgctagaagtagtggtaggcgttaagtttattaagtttagtacctaaaataatttaatttaattaagttacgttacggttaggtaaccgtttaccggaccgtaaaacggggaccgtaaagggttacggtaataacgtacgaagtaaccgtaaacgtcggttggacctcgacctaaccg

SEQ ID NO: 430516 - DNA, 782 bp, Homo sapiens
  misc_feature: GZ8MTXP02ITOTA.19.71.G05.1.454.CMB.2.raw
  modified_base (239)..(239): a, c, t, g, unknown or other
  modified_base (771)..(782): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccactaatcttttanacagttaccaaacaatagaaaactacttagctttaggaccagcagagaccaaggacagccttcaggctagctactagtttacgcgggactacgtaccgtaaccccggggaagttccccggggtccccctacggaaccccgtagtttcccgaaggttccgggacgtacggggtccgggggttaccgtacgggggtaaaccctaagggttaacctttttacccgaaacccgtttcccgttacccaaacccgttaacttaccgtaaaccggtacccgaacggtcccccgttaggaccccggttaaaccggggacgttaacgggtaaaaacggttcgttacggggttaacggggttaacgttttttaaacggttttttaaggtttttaaaccgtttaacggtttaaaaccctaaaaacgttttaaaagtttttaaaaacgttttttaatttttaaaaaccgttttaaacccggtttttcccgggggtttttaaaaccgggggttaaaccccgggggttttttaaacccccgggggnnnnnnnnnnnn

SEQ ID NO: 430517 - DNA, 651 bp, Homo sapiens
  misc_feature: GZ8MTXP02JN0RR.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgggtgaagccctcgcagaccctctcgctcacctgtgccatcgtccggggacagagtcgctagcgacagtgtgcttggcacgtgggtcaggcacgtccccatcgagaggtctagagtggctaggggaagactattattcatcgtaccaacgacgtaggaaactactaaattatacgacacctatcgtgttagagtagtacgactagaacaatacgaaacgtagaacactataccgaaacgtaacctagttccctacccgtagacctaacgtcctacggtacccttccgttacggtaccgtaacccgtaccccgggtaacgggaaccggtaaccggggttaggttaaactttaacgtttaacggtacgggttaacggggaaacggtacccggaccccctaaagttaaccggaacctaacgtaccgtaaccccgtacccgttacggtaccttcggtcggttacgtacgtttaacgg

SEQ ID NO: 430518 - DNA, 527 bp, Homo sapiens
  misc_feature: GZ8MTXP02IT500.19.71.G05.1.454.CMB.2.raw
  modified_base (345)..(345): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatctccggggacagagtcgctagcgacagtgttgcttggcactgggtcaggcacgtccccatcgagaggtctgagtggctggggaacggacagtatttcatgtccancgttagaaatacaaattactgcaccatctgttgagagtcgactgacaatcaaacgtagactacatacgaaaacgacctaagttcctaccctgacagctagacctcgtacgtcgacgtacccgaggacgacgggtgtaactagttaacgtggtacggaacgacggaccccctagtaacgaacg

SEQ ID NO: 430519 - DNA, 598 bp, Homo sapiens
  misc_feature: GZ8MTXP02GL78M.19.71.G05.1.454.CMB.2.raw
  modified_base (354)..(354): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccagtcgagaggtctaggagtggcgtgggaaggactatatttcattgtaccaaacgacggtaggaaactaacaaaatttancgcaaccattctgttagagagtcgatgaacaatacaaacgtagacacatacgaaagaacctaagttcctacccctgaccagctacgacccttcgttacgtacgacccgtacccggaacgggtaccgtacggggttacgttaattagttaacgtacggtagggtaaacggaacccgggaccccctaagtaaccgtaacaacgtcgaacccgtaccttccggtacctcgttggtcgtacttaacgg

SEQ ID NO: 430520 - DNA, 642 bp, Homo sapiens
  misc_feature: GZ8MTXP02IBTJK.19.71.G05.1.454.CMB.2.raw
  modified_base (229)..(229): a, c, t, g, unknown or other
  modified_base (237)..(237): a, c, t, g, unknown or other
  modified_base (246)..(246): a, c, t, g, unknown or other
  modified_base (250)..(250): a, c, t, g, unknown or other
  modified_base (256)..(256): a, c, t, g, unknown or other
  modified_base (259)..(259): a, c, t, g, unknown or other
  modified_base (267)..(267): a, c, t, g, unknown or other
  modified_base (306)..(306): a, c, t, g, unknown or other
  modified_base (376)..(376): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacatcaactgcaagtccagccanatctttanacatacaanatanaaactntanctagacancagagacagacacgcctcgtagctgctactagtttacgngggacctaacgtaccgtaacccggggtacgtccccggggtacccctagacccgtattcgaggtcggacgngggtccgggtcgtaggggacctagtactttaccacttcctaccaacctagtaccagtacgacgcctacgacgacgtacgtagtaagtagtagtacggtagttagtttagtttaagttagttaactaaactaattaatttaatttaagtttacgttacggttacggttacggttaccggtaaccggtaaacgggtaaccggtaacggtaacggtaacgtacgtaacgtaacggtaacggtaacgtacggtacggtacgtacgtaccg

SEQ ID NO: 430521 - DNA, 826 bp, Homo sapiens
  misc_feature: GZ8MTXP02FNKDK.19.71.G05.1.454.CMB.2.raw
  modified_base (209)..(209): a, c, t, g, unknown or other
  modified_base (212)..(212): a, c, t, g, unknown or other
  modified_base (220)..(220): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgnacngcagtacncgcacaatactttattacacgttacctaaccaaatagtaaactaaacttagtactcgttaccgacgacgacgaagaccgaacggaacgaacgacccgtcccgtacggtaccgtcgtctacctactttaacgtttacgggcgactacgtaccccgggaacgtacccggggtcccgtaccgtaccgacgttactacgtaggtccgacggtcgggggtccggttacgggtacggaacgtacgtttttaccgtaccttaaccctttccgaaacccctaacttcgtaacgacgtaaccgacccgttcggacgacgggaccgttacgaaaaggtaaagttcggtgggggttaccgtaaagtttttaaatttttaacggttagtttaacccgaaaaccttaaaagtttaaattttttaaatttaaacttaaacccgtttttacccgggttagggggttaaacccggttttacccggggaacccggttaaaaacgggggaaacccgggttaaacgggttaagggggttaattaaaactttacccggtaaaagaaaaccccggggttaaaacgtttcgggggtaggggtttacccgtaccggaacccgtaaaccc

SEQ ID NO: 430522 - DNA, 557 bp, Homo sapiens
  misc_feature: GZ8MTXP02IKTYK.19.71.G05.1.454.CMB.2.raw
  modified_base (242)..(242): a, c, t, g, unknown or other
  modified_base (246)..(246): a, c, t, g, unknown or other
  modified_base (251)..(251): a, c, t, g, unknown or other
  modified_base (254)..(254): a, c, t, g, unknown or other
  modified_base (259)..(260): a, c, t, g, unknown or other
  modified_base (265)..(265): a, c, t, g, unknown or other
  modified_base (294)..(294): a, c, t, g, unknown or other
  modified_base (348)..(348): a, c, t, g, unknown or other
  modified_base (386)..(386): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcgaactgcaagtccagcacatctttaacatcaanatanaactntantgacnncaganacagacagctctagctgctctatttacgnggacactccgtacccggtacgtcccgggtcccctacgaccgtatcgagtcgcgngggcggtcgtagggactagtacttcactctacacctancagcacgcctagcgaggcagaagtgtggtcgtacttagtttattattacgtactaaactaattattactttagtacgttcggtacggtacgttacggaccggtaaacgggtaaccgtagggtacgtaactacgtaacgaacgtacgtaacgttcggtacgtacgtacgacc

SEQ ID NO: 430523 - DNA, 556 bp, Homo sapiens
  misc_feature: GZ8MTXP02F1ILV.19.71.G05.1.454.CMB.2.raw
  modified_base (446)..(446): a, c, t, g, unknown or other
  modified_base (503)..(503): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtatcctgtcacaagtacagctgcagcagtcaggtccaggactggtgaagccctcgcagacccctctcgctcacctgtcgccatcgtccggggacagagtcgctagcgacagtgttgcttggcacgtgggtcaggcacgtccccatcgagaggtctagagtggcgtgggaagacatatttcattcgtccaaacgacgtaggaaatacgtaaaatttatagacacctatctgttgagtagtcgactagacaatacaaacgtagacacatacgaaacgaactaacgttcnccctagacacgctacgacctcgtcgtacgaccgtaccggacggaccgtaacggggtnttaacgttaacgttacgtaggtacgggaacggaccggaccccctaagtaaccg

SEQ ID NO: 430524 - DNA, 549 bp, Homo sapiens
  misc_feature: GZ8MTXP02IW8GB.19.71.G05.1.454.CMB.2.raw
  modified_base (499)..(499): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaagacatattcatcgtccaacgacgtaggaaatacaaatttatgaccactattcgtagttgagtagtcgactgaacaatcgaaagtagacaacatacgaaacgaaccctagttcctaccctgacaggtctacgtacctcgtggtcgacccgtacccggaacgtacgtaccggggttnttaaattaacgttacgtaggtacgggaaacgtaccggaccccaagtaacg

SEQ ID NO: 430525 - DNA, 658 bp, Homo sapiens
  misc_feature: GZ8MTXP02GQX9B.19.71.G05.1.454.CMB.2.raw
  modified_base (242)..(242): a, c, t, g, unknown or other
  modified_base (258)..(258): a, c, t, g, unknown or other
  modified_base (322)..(322): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccacaattctttanacagttccaacaatanaaactacttaagcttaggtaccagcagagaccaaggacagcctctaggctgctcgtatttacgngggctagtccgtaacccgggtaaacgtcccgggggtaccccctacggacccgtaatttccgaaggttcggcgtaggggtccggggtcgttacgggggaacctaggtaacttttcaacttctaccacccaatacgcgacccacgccgcgacgacgacgtagaagtagtaggtgtacgttagtttattagttacgtaactaaactaaattaatttaatttaacgtttacgtttacggttacggttacggttaccggtaaccggtaaacggtaacggtaacggtacggtaacgtacgtaacgtaacgtaacgtaacgtacggtacggtacgtacgtacg

SEQ ID NO: 430526 - DNA, 600 bp, Homo sapiens
  misc_feature: GZ8MTXP02I1KHG.19.71.G05.1.454.CMB.2.raw
  modified_base (237)..(237): a, c, t, g, unknown or other
  modified_base (254)..(254): a, c, t, g, unknown or other
  modified_base (314)..(314): a, c, t, g, unknown or other
  modified_base (373)..(373): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttaanactagtaccaacaatanaaactactagcttagacagacagacgacgagacacgcctacgaggctgctctatttacgnggactagtccgtaaccgggacgtccggggtacccctagaccgtattacgaggtcggacncgggtccgggttcgtacggggactagtactttccactctacaccatacacgacacgcctgacgacgctagaaagtagtaggtacggtacttagtttattacgttacgtaactaaactaattaatttaattacttacgtttacgtacggtacgttacggaacgtaaacgggacgtaacggtacgtaagtactaacgaacgtaacgtacgtacggtacgtcgtacgacg

SEQ ID NO: 430527 - DNA, 755 bp, Homo sapiens
  misc_feature: GZ8MTXP02G029J.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtggtcaggcagtccccatcgagaggtctaggagtggcgtaggggaagactagtatttcgattcgtaccaaacgtacggttaggaaacttaacgtaaaatttagtacgacctaaccctattccgttaggtttaggaacggttaacggttaccggtaaccgtttagggaaaccctaaacgttaaccgtaaaaccggttaaacggaaacccgtaaacctaaacgttaacccggaaaaccgtaaaccccgttaacggtttaccccttaccccgttacgacccgtaacggttacccttaccggtaaccccttcgttacgggttaccgtaacccgttaccccgggaacgggtaaccggtacgggggttagttaaagttaacgtttaaccggttagggttaacggggtaaacggtacccgggtaaccccctaaagttaaccggaacctacgttaccggaacccctaccgttccgtaccgttaccgtggtacgtacgtttaacgg

SEQ ID NO: 430528 - DNA, 528 bp, Homo sapiens
  misc_feature: GZ8MTXP02G60UU.19.71.G05.1.454.CMB.2.raw
  modified_base (234)..(234): a, c, t, g, unknown or other
  modified_base (432)..(432): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactactagcttgtaccagcagagaccaggacagcctcctaggctgctcatttactgggcatcctaccgggaatccggggtcctgaccgattcagtggcagcgggtctggggacagtattcactctcaccatcagcagcctgcaggctagaagatgtggctagtttattattagtacaaanattataattataacttcgtaggtacgttcggactaaagggacctaaggtcgaactatacaaggtacgaaacgtgttacggcgtacggacgtaaccg

SEQ ID NO: 430529 - DNA, 595 bp, Homo sapiens
  misc_feature: GZ8MTXP02FTJL9.19.71.G05.1.454.CMB.2.raw
  modified_base (238)..(238): a, c, t, g, unknown or other
  modified_base (317)..(317): a, c, t, g, unknown or other
  modified_base (366)..(366): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttaccaaacaatagaaaactacttagcttggtaccagcagagaccaggacagcctcctaggctgctcatttacgngggcatccgtacccggggaatccggggtcccctgaccgattcagtggcnggcgggtctggggacagtatttccacttctacaccatcagcacgcctgcagggctaggaaagagtggtacgggacttaggttttaattagttcgtaacaaactaatttaatttaatttaattacgtttcggtacggtaaccggtttacgggacccgtaaaaggggaccctaaaaggggttacggaattagtaaccgaacgtaacggtaacgtggtacggctacggaccc

SEQ ID NO: 430530 - DNA, 631 bp, Homo sapiens
  misc_feature: GZ8MTXP02IBEXI.19.71.G05.1.454.CMB.2.raw
  modified_base (240)..(240): a, c, t, g, unknown or other
  modified_base (253)..(253): a, c, t, g, unknown or other
  modified_base (381)..(381): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttttaanacagttaccaaanaatagaaaactacttagcttaggtaccagacagagacagacacgacctcctacggctgctactatttacgtaggcataccgtaacccgggaacgtaccggggtcccccgtcgaccgactcagtggcgngcgggtcgtgggacgagagtttactactcctaccaccaactacacgacacgcctcgcgaggcgtagaaagtaagtaggtggtacgtaagttttaagtttaatttagttacaaaactaaaattaaatttaaatttaaattaactttacgttacggtacggttacggtaccgtaaacgggtaaaccggaaacggtaacgggtaagtaagtaacgtaacgtaacgtaaacgtaaggtacggtacgtacgtacg

SEQ ID NO: 430531 - DNA, 536 bp, Homo sapiens
  misc_feature: GZ8MTXP02JKBA9.19.71.G05.1.454.CMB.2.raw
  modified_base (239)..(239): a, c, t, g, unknown or other
  modified_base (317)..(317): a, c, t, g, unknown or other
  modified_base (351)..(351): a, c, t, g, unknown or other
  modified_base (361)..(361): a, c, t, g, unknown or other
  modified_base (371)..(371): a, c, t, g, unknown or other
  modified_base (376)..(376): a, c, t, g, unknown or other
  modified_base (388)..(388): a, c, t, g, unknown or other
  modified_base (393)..(393): a, c, t, g, unknown or other
  modified_base (395)..(395): a, c, t, g, unknown or other
  modified_base (399)..(399): a, c, t, g, unknown or other
  modified_base (403)..(403): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccacgatacgaactgacaagtcagcacaatctttanacagtccaacaatgaaaactacttagcttaggtaccagcagagaccaggacagccttccaggctagctcatttaccgnggcactccgaccggacgtccggtcccctgacgtntcgagtcgcnggtcggtcgnggacngtacttcactcncactncncgcncgcncgcgagcgagagagtgtgtattagtttattagtagtactaataattaattattatacgttacgtacgtacgtacggacgaacggacgtacgtacgtaagtagaacgacgaacgtacgtgtacgtacgtacgtc

SEQ ID NO: 430532 - DNA, 663 bp, Homo sapiens
  misc_feature: GZ8MTXP02JU3A5.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgaccctctcgctcacctgtcgccatccgtccggggacagacgtcgctagcgacagtgttgcgttggctacgtgggtcaggcacgtccccagtcggagtaggtctaggaggtgggcgtaggggaagtactattacgtttacagttcgtacccaaacgtacggtaaggtaaaacttaacgtaaaatttcgtacgacctaacccgttattccgttggttaggagtacgtacggactaacgaacctaacgtaccgaaaacgtacgaaaccacgtaacgtaaccggaaaacgtaaacccgtacgttaccccttacccgtagaccgtacgtcctaaccggtacccttcgtaccgtacggtacccgtcccgggaaacggtaccgtaaccgggttattaaacgttaacgttaccggtagtacgggaaccggtaccgaccccgtaagtaaccg

SEQ ID NO: 430533 - DNA, 538 bp, Homo sapiens
  misc_feature: GZ8MTXP02F1VRW.19.71.G05.1.454.CMB.2.raw
  modified_base (237)..(237): a, c, t, g, unknown or other
  modified_base (315)..(315): a, c, t, g, unknown or other
  modified_base (361)..(361): a, c, t, g, unknown or other
  modified_base (409)..(409): a, c, t, g, unknown or other
  modified_base (415)..(415): a, c, t, g, unknown or other
  modified_base (421)..(421): a, c, t, g, unknown or other
  modified_base (433)..(433): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaacaatagaaaactacttagcttggtaccagcagagaccaggacagcctcctaggctgctcatttacgnggcactccgtaccgggaatccggggtcccctgaccgattcagtgcnggcggtctgggacagtatttcactctcaccatcagcagcctgcaggcngaaagntgtggntagtttatattnactaatattattacttagtacttcgtaggtacgttccggaccgaaagggacctaaggtacggtaatacgtaacgaaggtacgaaccgttggtaggacctggaccc

SEQ ID NO: 430534 - DNA, 666 bp, Homo sapiens
  misc_feature: GZ8MTXP02I6KWN.19.71.G05.1.454.CMB.2.raw
  modified_base (242)..(242): a, c, t, g, unknown or other
  modified_base (333)..(333): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgacaagtccagccaacaattcttttaanactacgttaccaaacaatagaaaacttacttagcttaggaccagcaagacgaccaggacacgccctccgtaggctgcctactagtttacgngggacacgttcccgtaacccggggtaagtccccggggtccctacggacccgtatttcgaaggttcggaccgtacgggtccgggggttctagggggaacctaggtacctttcgaaccttcctacccaaccctataccgagacccacgcccgtgaccacgggtctaaggaaagtagttcggtacggtacgttaagttttaattacgtttagtaacctaaataaatttatttaattacttacgttcggtacggtacgttacggaaccgtaaacggggaaccgtaggtagtaactacgtacgaagtaaccgtaacgtggtacgctacgacctaaccg

SEQ ID NO: 430535 - DNA, 555 bp, Homo sapiens
  misc_feature: GZ8MTXP02H8958.19.71.G05.1.454.CMB.2.raw
  modified_base (353)..(353): a, c, t, g, unknown or other
  modified_base (376)..(376): a, c, t, g, unknown or other
  modified_base (424)..(424): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcgttggcacgtgggtcaggcacgtccccatcgaggagtctagagtggcgtggggaaagacagtatttcatcgtcccaaanacgtaggaaataacaaagtttanagacaccattcgtgtagagtagtacgactagaactatacaaacgtaanaacactaagaacgaaacgaactacgttcctaccgagacagtctacgacctcgtacgtacgaccgtaccggaacggacgtacggttataacgttaagttacgaggtaacggaacgacccgaccctaagtacg

SEQ ID NO: 430536 - DNA, 622 bp, Homo sapiens
  misc_feature: GZ8MTXP02FFHO1.19.71.G05.1.454.CMB.2.raw
  modified_base (241)..(241): a, c, t, g, unknown or other
  modified_base (251)..(251): a, c, t, g, unknown or other
  modified_base (314)..(314): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctggcgagcgggccacatcgaactgacaagtccaagccactaatctttaanactatacaanatagaaactctagctgacagacagacgacagactacgcctcgaggctgtctactagttacggnggaccacgtccggtaaccccgggtacgtccccccggggtcctagaccgtatcgacggtcggcgagggtcgggtacgtacgggaactagttactttaccaccttacctaccgaacctagtcgacgacgacgtccgtacgacgacgacgtagtaagtagtgtagtacgttagtttattagttacgtaactaaactaaattaattaattacgttaacgttacggtacggtaccggtacggtacggtaaacggtaaccgtaacggtaagtaacgtaacgtacgaacgtacgtaacgtacgtacgtacgtacg

SEQ ID NO: 430537 - DNA, 613 bp, Homo sapiens
  misc_feature: GZ8MTXP02GQJUO.19.71.G05.1.454.CMB.2.raw
  modified_base (238)..(238): a, c, t, g, unknown or other
  modified_base (313)..(313): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactcttagcttggtaccagcagagaccaggacagcctcctaggctgctcatttacgnggcacgtccgtaccggacgtcccgggtccccctaggaccgtagttccgaggtcggacgtcggggtccgggttcgtaggggaacctagtactttccaccttcctaccaacctatacacgcgacgtcctagcgaggctagaaagtgttggtcgtacttagtttattatcgtaacaaataattatttaattacgttacgtttacggtacggttaccgttaccggaaccgaaacggggtaacctaaggggtacgtaacgttaacgtaacgtaaaggtaacgtacgtaggtacgtacgtacgacc

SEQ ID NO: 430538 - DNA, 701 bp, Homo sapiens
  misc_feature: GZ8MTXP02HM00C.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccatcgtccggggacagacgtcgctagcgacagtgttgcttggcacgtggtcaggctacgtccccagtccggagtaggtctaaggaggtggtacgtaggggaaagtactagttacttttcgaagttcgtacccgaaacgtaacggttaggaaaacttaaccgtaaaatttatacgacctaacctattcgttaggttaggtaagtagttaccgaacttacgaaactaaacgttaccgaaaacggttacgaaacctaaacgtaaacgttaaccgggaaaacgtaaaccctacggtttacccctaccccgttaggacctaacgtccgtacggtaaccccttcgtacggttaccgtaacccgttaccccggaagggtaacccggtacggggttaacttaacgtttaagttaccggttaggtaacggggtaaaccggacccgggtaaccccctaagttaaacccgg

SEQ ID NO: 430539 - DNA, 607 bp, Homo sapiens
  misc_feature: GZ8MTXP02HXQVB.19.71.G05.1.454.CMB.2.raw
  modified_base (240)..(240): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccacaattctttanacagttccaacaatagaaaactacttagcttaggtaccagcagagaccaggacagccctcaggctgctctatttacngggcacgtcgtaaccccggggaatccccggggtcccctagacccgtattccgaggtcggacaggggtccgggtactaggggacctaggtactttccactcctacctaccatcgagccacgccctagccaggactagaagtagtggtggtacgttaaggttttatagttagtactaaataattaatttattaatacgttcggtacggtaccggttacggaaccgtaaacggtaccgggggtaagtacggaatacgtaacgtaacgaacgtaacgtgtacggtctacgaccg

SEQ ID NO: 430540 - DNA, 622 bp, Homo sapiens
  misc_feature: GZ8MTXP02I2IVG.19.71.G05.1.454.CMB.2.raw
  modified_base (236)..(236): a, c, t, g, unknown or other
  modified_base (244)..(244): a, c, t, g, unknown or other
  modified_base (254)..(254): a, c, t, g, unknown or other
  modified_base (258)..(258): a, c, t, g, unknown or other
  modified_base (263)..(263): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggcctacgactacggacgtcgactaagcagcanatctttanacactacaanatanaactntagctcgacagacagacgacagacacgcctacgtagtctcgactactacttacgtcgtacgtacgtaccgtaccggtacggtaccggtaccccgtacgtaccgtacgtacgtacgtacggacgcggtcgggtacggtacggtacgtacgtacgttactactactacctactactacgacgacgacgcgacgacgacgacgtacgagtagtacgtacgtacgttagttagttacgtacgtactaactaattattattacgttacgttacgttacggtacggtacggtaacggtaacggtaacgtaacggtacgtacgtacgtaacgtaacgtaacgtacgtacgtacgtacgtacgtacg

SEQ ID NO: 430541 - DNA, 563 bp, Homo sapiens
  misc_feature: GZ8MTXP02I4QBZ.19.71.G05.1.454.CMB.2.raw
  modified_base (475)..(475): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggctaggggaagacattatttcatcgtaccaacgtacgtaggaaatacgaaattatgaccccccagatctgtagagagtacgactagacaatacaaacgtagaacacatacgaacaacctgttacctaccctgacgagtcgtcgacctctgtacgaacctcccggaagaccgtaagggttntaatacgttacgtaggtaggaaacgtaccggaccccaagtacgaactacgtacgccctacccgtcgttactcgtgggtctacttacgg

SEQ ID NO: 430542 - DNA, 544 bp, Homo sapiens
  misc_feature: GZ8MTXP02HP2IQ.19.71.G05.1.454.CMB.2.raw
  modified_base (239)..(239): a, c, t, g, unknown or other
  modified_base (316)..(316): a, c, t, g, unknown or other
  modified_base (538)..(538): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccacgatacactgacaagtccagccataattctttanacagttaccaacaatagaaaactctagcttaggaccagacagagaccaggacagcctctaggctgctctatttacgngggactagtccgtacccgggaatcccggggtacctagacccgtattccgaggtgcgagccggggtctgggactagtacttcacttcacacccatacgagcacgccgtcgacgacgcgtagaagagtagtgtacgtagtttattattatactaataatattattattactgtagtacgtcgtacgacgacgaagagagtatacgaagacgacgtacgtagtcncgacac

SEQ ID NO: 430543 - DNA, 543 bp, Homo sapiens
  misc_feature: GZ8MTXP02HZUUM.19.71.G05.1.454.CMB.2.raw
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagaggtctagagtggctggggaagacatatttcattcgtccaaacgacgtggaaactaacaaattatcgacactatctgttagagtagtacgatagactaatacaaacgtagacagaatacgaaacgaaccctagttcctacccgtgcacgctacgtacctctgtacgacctacccggtaacgacgtacggtagttaacgtaacgttacgtaggtacggaacgaccggacccctagtaacg

SEQ ID NO: 430544 - DNA, 589 bp, Homo sapiens
  misc_feature: GZ8MTXP02IQICO.19.71.G05.1.454.CMB.2.raw
  modified_base (239)..(239): a, c, t, g, unknown or other
  modified_base (318)..(318): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttaanacacgttaccaaacaatagaaaactactagcttggtaccagcagagaccaggacagcctcctaggctgctctatttacngggacatccgtacccgggaatccggggtcccctcgaaccgtattcgagtacggcacgggtcgggtcgtaggggactagtactttccgactctcacccatcagtccagccctgccgtaagggctaaggaagacgtggtcggtactagtttactattcgtactaaactaatatttatattacgttacggttacggacgtttcggaccgtaaacgggacgtaagggtacggactaagtaacgacggaaccgtacgtaggcgtacgttcgaaccg

SEQ ID NO: 430545 - DNA, 611 bp, Homo sapiens
  misc_feature: GZ8MTXP02HT0ES.19.71.G05.1.454.CMB.2.raw
  modified_base (320)..(320): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgcctactcgtcccggggacagacgtcgctacgcgacagtgttgcttggcacgtgggtcaggcacgtccccatcgagaggtctagngtggctaggggaagacagtatttcattgtccaaactacgtggaaataacaaattatgacaccaatctgttagagtagtacgactagaaacagtacgaaaacgtagaacaacgtaagtacgaaaacggaaccctagttaccctacccgtaggaccaggaccttacgaacccgttcgtacggttaccgaccttacccggggaacggaaaccggtaccgggggttacttaaagtaacgtttaacggttaccggtaggggtaaaacgacccgggacccccttaaagtaaacccgg

SEQ ID NO: 430546 - DNA, 569 bp, Homo sapiens
  misc_feature: GZ8MTXP02JCUQD.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggacctcccacaaggtgtcctgtcacaagtacagctgcagcagtcaggtccaggactggtgaacgccctcgcagacccctctcgctcacctgtgccatcgtccggggacagagtcgctagcgacagtgttgcttggcacgtggtcaggcacgtccccagtcggagacggtctaggagtggcgtaggggaaagactagttactttcgagttcgtccaaactacggtaggtaaactaacgtaaatttagacgactacctatcgtagttagaagtagtacgactagaacaatacaaacgtagacaacagtacgaaacgtaaaccacgttacctcccgtcgacagtactacgtaccctctgtacgaccgtaccggacggacgtacggtagtataacgttacgtagtacggacgacggaccccagtaacg

SEQ ID NO: 430547 - DNA, 590 bp, Homo sapiens
  misc_feature: GZ8MTXP02HD2GX.19.71.G05.1.454.CMB.2.raw
  modified_base (243)..(243): a, c, t, g, unknown or other
  modified_base (254)..(254): a, c, t, g, unknown or other
  modified_base (323)..(323): a, c, t, g, unknown or other
  modified_base (384)..(384): a, c, t, g, unknown or other
  modified_base (454)..(454): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacatcaactgacaagtccagccactaattctttanacagttccaanaatagaaaactcttagcttaggtaccagacagacgaccaggacacgcctcaggctgactctatttacgngggacataccgtacccggggaacgtcccggggtccccctagaccgtattccgaggtcggcngggtccgggtcgtaggggactagtacttcacctctcaccatcagacagccctgaccgaggctagaaagtntcggtagtacgttagtttagttattacgtactaaataatttacttaattacgtacgttcgtacggtacgttccggaaccaaaggggaccgtaaggtcgtatagaaccgtaagacgtacgtgtacggactagacccg

SEQ ID NO: 430548 - DNA, 636 bp, Homo sapiens
  misc_feature: GZ8MTXP02GL4G9.19.71.G05.1.454.CMB.2.raw
  modified_base (244)..(244): a, c, t, g, unknown or other
  modified_base (256)..(256): a, c, t, g, unknown or other
  modified_base (261)..(261): a, c, t, g, unknown or other
  modified_base (319)..(319): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacatcgaactgacaagtccagccactaattctttanactactaccaanaatanaaactactagcttagacagcagacgacgagacacgcctcgagctgctactactttcgnggctacgtaccgtacccgggacgttcccggggtcccctacgaccgtattacgaggtcggacgcggggtcgggtcgtacgggactagttactttccacctcctaccaacctactacgacgccgacgtcctagacgaggactaggaaagtgtaggtaggtacttaagtttattagttacgtaactaaattaatttaagtttaattacgtttacgttacggttacggttaccggttaccggaaaccggtaaacgggtaaccggtaagggtacgtaactaacgtaacgaacgtaacgtaacgtcggtacggacgtacgacg

SEQ ID NO: 430549 - DNA, 608 bp, Homo sapiens
  misc_feature: GZ8MTXP02I3U3U.19.71.G05.1.454.CMB.2.raw
  modified_base (239)..(239): a, c, t, g, unknown or other
  modified_base (315)..(315): a, c, t, g, unknown or other
  modified_base (345)..(345): a, c, t, g, unknown or other
  modified_base (362)..(362): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccacaatcttttanacagttccaacaatagaaaactacttagcttggtaccagcagagaccaggacagcctctaggctgctcatttacgnggctactcgtaccggacgtccgggtccccngaccgtatcgagtgcgnggcggtcgagggacagtactttacactctacaccatcacgcacgcctgcgacggactagaaagtgtggtacgtagttagtttattacgttacgtaactaaataaattaatttaacttaacgtttacgttacggttacggttaaccggttaccgggaaccggtaaacggggtaaaccgtaaagggttacggtaagttaacgtaacgtaaacggtaaacgttaacggtcggtacggtacgtacgaacg

SEQ ID NO: 430550 - DNA, 709 bp, Homo sapiens
  misc_feature: GZ8MTXP02HGMUI.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtcgtccggggacagacgtcgctagcgacagtgtgcgttggctacgtgggtcaggcacgtccccatcgaggagtcgtaggacggtggacgtaggggaaaggtactagttactttcgagttcgtacccaaacgtaacggttaggtaaaattaaaccgtaaaatttacgtacggaaccctaaaccctaagtttccgttaggtttacgaaaggtacggttaccgaacgttacggaaacctaaacgttaccgaaaacggttaagaaacccaaaccgtaagttaacccgggaaaacggtaaaaccccgttccgtttaccccttaccgacggtacgaaccggtcctaaccgtcccgttacgtacggttaccggaaccccgttaccgggaaccgggtacggttaacgggttaactttaacgtaacgtttaacggtacggtacgggaaacgaccccgtaacccgtaagtaacccg

SEQ ID NO: 430551 - DNA, 533 bp, Homo sapiens
  misc_feature: GZ8MTXP02F9GKA.19.71.G05.1.454.CMB.2.raw
tcagtactctcgtgcacgaccggtgctcgatttagtgtcgtcgcaagagagaggggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttatacagttccaaacaatgaaaactacttagcttggtaccagcagagaccaggacagcctcctaggctgctcatttactgggcatcctaacccggggaatccggggccccctgaccgattcagtggcagcgggtctagggacagatttcactctcaccatcagcagccctgcaggctgaaagatgtggctagttttaatattgcaaaacaattaattattaagtacttcgtggaacttcggactaaagggacctaaagggtgattatcgagaacgaaacgttgtacggctacgacc

SEQ ID NO: 430552 - DNA, 597 bp, Homo sapiens
  misc_feature: GZ8MTXP02IU7IR.19.71.G05.1.454.CMB.2.raw
  modified_base (244)..(244): a, c, t, g, unknown or other
  modified_base (337)..(337): a, c, t, g, unknown or other
  modified_base (404)..(404): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcgaactgacaagtccagccacaattccttttaanactacgttaccaaactaatagaaaactacttagtcttacggtaccagacaagacgaccgaggacacgcctaccgtagctgctactatttacgnggactacgtaccgtacccgggtaacgtcccggggtcccctacgtaccgtacttacgaggtcggacgnggggtccgggtcgtacggggactagtactttcactcctacacctatcagcacgcctgcgagcagaagtagtgtgtattagtttatagttgtaactaactaattaattattaacgtacgttcgtacggtacgttacggacgtaaacgggaacgtaggtagtatataacgaacgacgtactgtacgtactacgcg

SEQ ID NO: 430553 - DNA, 561 bp, Homo sapiens
  misc_feature: GZ8MTXP02JMPC5.19.71.G05.1.454.CMB.2.raw
  modified_base (241)..(241): a, c, t, g, unknown or other
  modified_base (319)..(319): a, c, t, g, unknown or other
  modified_base (370)..(370): a, c, t, g, unknown or other
  modified_base (424)..(424): a, c, t, g, unknown or other
  modified_base (460)..(460): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgaggcgggccaccatcaactgacaagtccagccacaattctttanactagttccaaacaatagaaaactacttagcttaggaccagcagagaaccagacagcctctaggctgctctatttacnggcacgtccgtacccgggagtcccgggtccctgaccgtattcgaggtgacngggcggtcgagggacagtatttcacttcacacactcgagcagccctgcgtacgngagaaagtgtggtacgatttaagtttatacgttaanaactaaaatattaattattatcgttcgtacgtacgtacggaaccggtaaaggacgtaggtacgtaataagaacgaaacggaacgtacgtggtacgtcacac

SEQ ID NO: 430554 - DNA, 591 bp, Homo sapiens
  misc_feature: GZ8MTXP02IGI24.19.71.G05.1.454.CMB.2.raw
  modified_base (350)..(350): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcagtccccatcgagaggtctaggagtggctagggaaggacattatttcatcgtaccaaacgacgtaggaactaacaaatttancgacacctatcgtgttagacgtagtacgactagaacaactacaacgtaacgaacaacaacgtacgaaacgtaacctacgttacctaccgtagactacgtcctacgtaccttcgtacgtaccgtacccgtaccggaggtacgtacgggttattacgtacgttacgtacggtacggaacgaccgaccctaagtacgactacgtaccgaacccgtaccgttcgtctcgtacggtcgtacgttag

SEQ ID NO: 430555 - DNA, 540 bp, Homo sapiens
  misc_feature: GZ8MTXP02GJ0E9.19.71.G05.1.454.CMB.2.raw
  modified_base (238)..(238): a, c, t, g, unknown or other
  modified_base (281)..(281): a, c, t, g, unknown or other
  modified_base (311)..(311): a, c, t, g, unknown or other
  modified_base (360)..(360): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactactagcttggtaccagcaganaccaggacagcctcaggctgctcatttacnggcatcgtaccgggatccccggggtcctgaccattcagtgcagcgggtntgggacagtactttcactctacacatcagcagcctgcagctagaagagtgtggactagtttatacttgactaaactaattattaattattaacttcgtacggtacgttacggaccgtaaaggggtaccaaagggtggtaataacgtacgaaacggtaacgaacgtaggtacggactacgg

SEQ ID NO: 430556 - DNA, 628 bp, Homo sapiens
  misc_feature: GZ8MTXP02G942T.19.71.G05.1.454.CMB.2.raw
  modified_base (390)..(390): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagacgtcgctagcgacagtgtgcgttggcacgtcgggtcaggcacgtccccagtcggagaggtctagagtgggcgtaggggaagtactagttactttacattcgtaccaacgtacgtaggaaatactaaaatttanagacctaacctattacgttagttggaagtacgttacggaacttacggaaactaaacgtacgaaaacggtacgaaaccaacgtaacgtaacggaaacgtaacccgtacgttacccgtaccctcggtacgacgtccgtacgtacccttcgtacggtacgtacccgtcccggaacggtaccgtacgggttacgttaaagtaagttaacgtggtaacggaacgaccggacccctaagtaacg

SEQ ID NO: 430557 - DNA, 588 bp, Homo sapiens
  misc_feature: GZ8MTXP02G67LZ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgtgcttggcacgtgggtcaggcacgtccccagtcgagaggtctaggagtggcgtaggggaaggactagtatttcattcgtccaaacgtacgtaggtaaataactaaaattatacgacctaactattctaggttagaagtacgtacgactagaactactacaaacgtagaacacaagtacgaaacgtaaccctacgttcctacccgtgaccgagcctacgacccttcgtcggtacgtaccgtacccggacggtaccgtacggttagttaacgttaacgttacgtaggtacggaacggaccggtacccccgaagtaaccg

SEQ ID NO: 430558 - DNA, 657 bp, Homo sapiens
  misc_feature: GZ8MTXP02I97NO.19.71.G05.1.454.CMB.2.raw
  modified_base (238)..(238): a, c, t, g, unknown or other
  modified_base (248)..(248): a, c, t, g, unknown or other
  modified_base (252)..(252): a, c, t, g, unknown or other
  modified_base (262)..(262): a, c, t, g, unknown or other
  modified_base (311)..(311): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgactaagtccagccacaatctttanacagtacaanatanaaactactanctgacagacagacgacagacacgtcctcgtagctcgctactagttacgnggactacgtacccggtaaccgggtaacgtcccggggtacctacggtaccgtacttacgacggtcggaccgtacgggtccggggttacgtacggggtaacctagttactttaccaccgttctaccaaccgtactacgtacgacgacgtacgtcgacgacgtacgtagtaacgtagtaggtacggtacgttaagtttaagtttagttacgttaactaaactaattaatttaatttaacgttacgttacgttacggttacggttacggtaccggtaacggtaacggtaacggtacgtacgtaacgtacgtaacgtaacgtaacgtacggtacggtacgtacgacgtacg

SEQ ID NO: 430559 - DNA, 537 bp, Homo sapiens
  misc_feature: GZ8MTXP02IJ9TU.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctggggaagacatatttcattcgtccaaacacgtaggaaataacaaattatacgacacaattctgttgagtagtcgactagacaatacaaacgtagaacaactagtacgaaagaacctagttcctacccgtagcagctacgaccttctacgtcgacctacccggaggaccgtacgggtagtataagttacgtaggtacggaaacgtccggaccccataacg

SEQ ID NO: 430560 - DNA, 555 bp, Homo sapiens
  misc_feature: GZ8MTXP02HYVX1.19.71.G05.1.454.CMB.2.raw
  modified_base (242)..(242): a, c, t, g, unknown or other
  modified_base (322)..(322): a, c, t, g, unknown or other
  modified_base (365)..(365): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaagtccagccacaattcttttanacagttaccaacaatagaaaactacttagcttaggtaccagcagacgaccaggacacgcctcaggctgctctatttacgngggctagtccgtaaccccgggatcccggggtcccctgaccgtntcgagtcgcgtggcgggtactgggactagtactttcactctacaccatcacgcacgcccgtgacgacggctagaagtagtgtggtattaagtttattattagactaaataattattattatacgttcgtagtacgttacggaccaaggggtacaaggtagaatagtaacgagacgtacgtgcgcgtacac

SEQ ID NO: 430561 - DNA, 576 bp, Homo sapiens
  misc_feature: GZ8MTXP02HTK23.19.71.G05.1.454.CMB.2.raw
  modified_base (242)..(242): a, c, t, g, unknown or other
  modified_base (318)..(318): a, c, t, g, unknown or other
  modified_base (347)..(347): a, c, t, g, unknown or other
  modified_base (352)..(352): a, c, t, g, unknown or other
  modified_base (362)..(362): a, c, t, g, unknown or other
  modified_base (369)..(369): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccataattcttttaanacagttcccaaacaatagaaactactagcttaggaccagcagacgaccagacagcctcgtagctgctcatttacgnggcatccgtaccgggatccggggtccccngaccnttcagtcgcngcgggtntgggactagtactttcactctcaccatcagcacgccctgaccgaggctaggaagtagtggtacggtcttaagttttattagtttagtaactaaataaatttatttataatttacgttcggtacgggtacgtttccgggaactaaacggggaaccgtaaagggtggtaacttacaacgtacgaacgtaacgttgtacggacttgaccc

SEQ ID NO: 430562 - DNA, 613 bp, Homo sapiens
  misc_feature: GZ8MTXP02JJHRF.19.71.G05.1.454.CMB.2.raw
  modified_base (238)..(238): a, c, t, g, unknown or other
  modified_base (315)..(315): a, c, t, g, unknown or other
  modified_base (349)..(349): a, c, t, g, unknown or other
  modified_base (360)..(360): a, c, t, g, unknown or other
  modified_base (369)..(369): a, c, t, g, unknown or other
  modified_base (394)..(394): a, c, t, g, unknown or other
  modified_base (414)..(414): a, c, t, g, unknown or other
  modified_base (428)..(428): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgacaagtcagccacaatctttanacagttaccaaacaatagaaaactactagcttggaccagcagacgaccaaggacagcctctaggctgctcatttacnggcatccgtacccgggatccgggcccctgaccgnttcgaggtgcngggcgggtntaggggacagtactttcacttaccncaacctactcacgcacgccngcgagcgtagaagngtggtagtacttagtttaattagttacgtaactaaaattaaatttaactttaagtttaacgttacgtttcgggtaacggttaccggttaccgggaacggtaaaacgggtaaccggtaaaggggttacgtaacgttaacgaacgtaaacggtaaccggtaacggttggtacggtacgttacgaacg

SEQ ID NO: 430563 - DNA, 677 bp, Homo sapiens
  misc_feature: GZ8MTXP02G8DDT.19.71.G05.1.454.CMB.2.raw
  modified_base (243)..(243): a, c, t, g, unknown or other
  modified_base (320)..(320): a, c, t, g, unknown or other
  modified_base (385)..(385): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggcggccaccatcaactgacaagtccagccactaattctttanacacgttaccaaactaatagaaactctagcttaggaccagcagagaccaggacagcctctaggctgctcatttacgnggctacgtaccgtacccggggaagtccccggggtccccctagaccgtattcgacggtcggaccgnggggtccggggttgcggggaactagtactttccactttacccacaaccctatacgaacggcctacgcccgtaggaccgaagggttcaaggaaagtggttagggtacggtactttaaggtttttaacgttattcggtaaaacctaaattaaatttaattttaagttaacctttcgtttacgggttaacggtaccggtttaccggaaaccggaaacggggtaaccgttaaggggtacgtaacttagtaacgaaacggtaaccgttaaggtcggtacgggtacctacggaacccg

SEQ ID NO: 430564 - DNA, 537 bp, Homo sapiens
  misc_feature: GZ8MTXP02GRJKQ.19.71.G05.1.454.CMB.2.raw
  modified_base (238)..(238): a, c, t, g, unknown or other
  modified_base (313)..(313): a, c, t, g, unknown or other
  modified_base (361)..(361): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatcctacccgggaatccggggtccccctgaccgattcagtggcnggcgggtctgggacagtatttccactctcacccatcagcagccctgcagggctagaagatgtggctagtttattatgtacaataattattattatacttcggtacgtaacgttcggacccgtaaagggaccaaaggttcgaattacgcgaagaaccgtaactgtacgcgtcgaccg

SEQ ID NO: 430565 - DNA, 688 bp, Homo sapiens
  misc_feature: GZ8MTXP02F2IFH.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtcgctagcgacagtgttgcttggcacgtgggtcaggcacgtccccatcgagaggtctagagtggcgtaggggaaggactaattatttcagttcgtacccaaacgacggttaggaaaattaactaaaagtttatacgaccaaccctaattcgttaggttagaaggtacgtaccgtaacgttacggaactaaactaccgaaaaccggttaacgaaaccaacctaagttaacccggaaaacggtaaaccctaacggtttaccctaccccgttaggacccaacgtccgtacggtaaccccttcgttacggttaccggtaacccgttaccccgggaacgggtaaccggtaaccgggggttacgttaaagttaacgtttaaccggtagggttaacggggaaaccggtaacccggggacccccctaagttaaacccgg

SEQ ID NO: 430566 - DNA, 576 bp, Homo sapiens
  misc_feature: GZ8MTXP02GJD5Z.19.71.G05.1.454.CMB.2.raw
  modified_base (241)..(241): a, c, t, g, unknown or other
  modified_base (258)..(258): a, c, t, g, unknown or other
  modified_base (322)..(322): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatcaactgacaagtccagccacaattctttaanactactaccaacaatanaaactactagcttaggaccagacaagacgaccagacacgcctacgtagctgctactatttacgnggactacgtaccgtaccgggaacgtcccggggtcccctacgaccgtatcgaggtcgcgcgggcggtcgtagggactagtacttcactctacacancancacgcngcgagacagaagtgtgtgtatagtttattatacgtactaaataattattattacttacgttacggtacggtacggttacgaaccggtaaacggtaacgtaaggtacgtaataagtaacgaacgtaacgtacgtggtcgtacgtacgaacc

SEQ ID NO: 430567 - DNA, 581 bp, Homo sapiens
  misc_feature: GZ8MTXP02G4OGO.19.71.G05.1.454.CMB.2.raw
  modified_base (371)..(371): a, c, t, g, unknown or other
  modified_base (379)..(379): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgtgcttggcacgtgggtcaggcacgtccccatcgagagtctagagtggcgtggaacgactatattcagtcgtaccacgacgtaggaaattacgaaatttagngactactntactgtgtagagtacgaccgtagaacaactacaacgtaagtacaacgaactacgaacgtaaacgtaacgttacctaccgtcgtacgacgacgtactaccgtccgttacgtacgtaccgtacccggtaccggacggtaccggtaggttacttaacgttaaccgtaggttacggaacggaacgtaccccgtaactacgtaaccg

SEQ ID NO: 430568 - DNA, 647 bp, Homo sapiens
  misc_feature: GZ8MTXP02F5509.19.71.G05.1.454.CMB.2.raw
  modified_base (328)..(328): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatccgtccggggacagacgtcgctagcgacaggtgttcgcgttggcacgtgggtcagggcacgtccccagtcgagtacggtctagngtggcgtaggggaagactattattcattcgtccaaacgtacggtaggaaaactaactaaattatcgaccacgtatcgtagttgaagtacgtccgtaacgtacgaactaaactaccgtaaaacggtaacgaaacctaacgtaacgttaaccggaaaacgtaaacctacgtttaaccctcccggtacgtacgacggtacctaccgtaaccgttccgtacggtaccggaacccgttacccgggaaacggtacccggtaacggggttacttaacgttaagtttaaccgtaggtacggaaccggtaccgacccctaagtaaccg

SEQ ID NO: 430569 - DNA, 601 bp, Homo sapiens
  misc_feature: GZ8MTXP02IFWIG.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatcgtccggggacagacgtcgctagcgacagtgttgcgttggcacgtgggtcaggcacgtccccatcgagaggtctagagtggcgtaggggaagactagtatttcgattcgtccaaacgacgtaggaaattaacaaaatttatacgacctaacctattacttgttagagtagtcgactagaacaataccgaaacgtagaaccactaatacgaaacgtaaccctacgtttcctacccgtagacccaagtcctacgaaccctttcgtaggttaccgaacccgtaccccggaaggaaccgtaccggggttattaacgttaagtttacgtaggtacgggaaacgtcccggacccctaagtaccg

SEQ ID NO: 430570 - DNA, 532 bp, Homo sapiens
  misc_feature: GZ8MTXP02H4D0U.19.71.G05.1.454.CMB.2.raw
  modified_base (239)..(239): a, c, t, g, unknown or other
  modified_base (317)..(317): a, c, t, g, unknown or other
  modified_base (364)..(364): a, c, t, g, unknown or other
  modified_base (393)..(393): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtggcgagcgggccaccatcaactgcaagtccagccacaatcttttanacagttaccaacaatagaaaactactaagcttggtaccagcagagaccaggacacgcctctaggctgctctatttacnggcataccgtaccgggaatccggggtcccctgaccgatcagtcggcnggcgggtctgggacagtactttcaactcncacatcagcagcctgcagggctagagtatggtggtctagttattattgactaataattattattatacgttcgtggtacgttcggaccaaagggacctaaggtcgatactaacgaacgacgaacgtgacggctagaacc

SEQ ID NO: 430571 - DNA, 631 bp, Homo sapiens
  misc_feature: GZ8MTXP02IJWV5.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcaccctgtcgcccatcgtccggggacagagtcgctagcgacagtgtgcttggcacgtgggtcaggcacgtccccatcgagagtctagagtggctggggaagacattatttcagttcgccaaacgtacgtaggaaataactaaaatttatcgacacccaattctagtttaggaagtacggtacgaacgttagaaacctaaagtacaaacgttaacgaactaacaagtacgaaaacgtaaaccctagtttacctaccccgtgactaacggtcctacgaacccttcgtacgttacggaacccgttacccgggaaccggtaaccggtaaccggggttacgttaagttaacgtttaacggtacggttacggggaaaacgtacccgggaacccccctaagtaaaccgg

SEQ ID NO: 430572 - DNA, 558 bp, Homo sapiens
  misc_feature: GZ8MTXP02JMNYZ.19.71.G05.1.454.CMB.2.raw
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacaggacgtcgctagcgacagtgttgcttggcacgtgggtcaggcagtccccagtcgagaggtctaggagtggcgtagggaacggacagttatttcatcgtacacgacgtaggaaatacaaattatgacacatactgttagagagtcactgacaatacaacgtagacacgatacgaaagaacctagttacctcccgtagcacgtccgtacgtaccctcgtacgtcgacccgtacccggacgggtaccgaggggttacgttactagttaaccgtaggtacggaaacgccggacccctaagtacgaaccg

SEQ ID NO: 430573 - DNA, 599 bp, Homo sapiens
  misc_feature: GZ8MTXP02HZ6SY.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatcgtccggggacagagtcgctagcgacagtgtgcgttggcacgtgggtcaggcacgtccccagtcgagtaggtcgtagaggtggcgtaggggaagtactattatttcagttcgtaccaaacgtacgtaggaataacaattactgacacatctagttagagtacgtcgtactagaacaatacaaacgtagaaccaactaacgtaccgaaacgtaacctacgttaccctacccgtacgctaacgccgtacgtacccttcgtgtaccgtaccgtacccggaaggtaccggtacgggttcgttaaacgttaagttaccggttaggtacgggtaaacgacccgggtacccctaagtaacccg

SEQ ID NO: 430574 - DNA, 642 bp, Homo sapiens
  misc_feature: GZ8MTXP02FRH2E.19.71.G05.1.454.CMB.2.raw
  modified_base (243)..(243): a, c, t, g, unknown or other
  modified_base (339)..(339): a, c, t, g, unknown or other
  modified_base (400)..(400): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccactaattccttttaanactacttaccaaataatacgtaaaacttacttagtacttacggtaccagacaagaacgaccgaaggacacgcctacgtaggctgctactattacgnggactacgtaccggtaaccggacgtcccggggtaccctcgaccgtattcgaggtcggacgngggtccgggtcgtagggactagttacttccactctacactatcacgcgacgcctgacgacgacgtagaaagtgtaggtacggtactttaagtttacttagttacgtaactaaaacttaagtttaaatttaagttaacgttacgttacggtacggtaccggttacgggaaaccgtaaacgggtacgtaagggtacgtaactaagtaacgtaacggtaacgtacgtacgtacgtacgtacgtac

SEQ ID NO: 430575 - DNA, 537 bp, Homo sapiens
  misc_feature: GZ8MTXP02HIY7Z.19.71.G05.1.454.CMB.2.raw
  modified_base (229)..(229): a, c, t, g, unknown or other
  modified_base (240)..(240): a, c, t, g, unknown or other
  modified_base (318)..(318): a, c, t, g, unknown or other
  modified_base (361)..(361): a, c, t, g, unknown or other
  modified_base (375)..(375): a, c, t, g, unknown or other
  modified_base (419)..(419): a, c, t, g, unknown or other
  modified_base (514)..(514): a, c, t, g, unknown or other
tcagtactctcgtgcacgaccggtgctcgatttagtgtcgtcgcaagagagaggggggagggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcggccacatcaactgcaagtccagccanaattcttttanacagttccaaacaatagaaaactacttagcttggtaccagcagacgaccaggacagcctctaggctgctcatttacgnggcactccgtaccccggggaatcccggggtccccctgaccgtnttcgaggtcggacngggtcgggtctaggggactaggtactttcactctcaccatcgancagccctgcaggctagagatgtggtacttagtttattatacgtacaactaattatttatattactcgtaggcgttcgacgaaggtacagtcgatnaacgagtacattgcggactgacc

SEQ ID NO: 430576 - DNA, 637 bp, Homo sapiens
  misc_feature: GZ8MTXP02FY361.19.71.G05.1.454.CMB.2.raw
  modified_base (240)..(240): a, c, t, g, unknown or other
  modified_base (322)..(322): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgcgccaccatcaactgcaagtccagccactaattcttttanacagttccaaacaatagaaaactacttagcttaggtaccagcaagacgaccaggacagcctctaggctgctactatttacgngggactagtccgtaacccggggaagtcccggggtccccctagacccgtattcgaggtcggcgtagggccgggtcgtaggggaacctagtactttccactcctacaccatcagcacgcctgcgaggactagaaagtacgtggtacggacttaagttttaattagttacgtactaaaactaatttaattaacttaagttacgttacggttacgggtaccgtttaccgggaccgtaaaacggggtaaccgtaaaggggttacgtaattaagtaaccgtaaaggtaaacgtaaacgtgggtacggacgttacggaaccc

SEQ ID NO: 430577 - DNA, 585 bp, Homo sapiens
  misc_feature: GZ8MTXP02JKS9Q.19.71.G05.1.454.CMB.2.raw
  modified_base (364)..(364): a, c, t, g, unknown or other
  modified_base (524)..(524): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgtgcttggcacgtgggtcaggccagtccccatcgagaggtctagagtggctaggggagacatattcatgtccaacacgtggaaatacaaagttancgacacctatctagttacgagtagtcgactagaacaatacgtaaacgtagaacacaacgtacggaaaacgtaaacctacgtttcctacccgtgaccgtaacgccttacgacccttcgtcgttaccgacccgtacccggaacggtaccgtaacgggggttnttaacgttaacgttaccgttacggttaagggaaccgtacccgggaccccctaagtaacccg

SEQ ID NO: 430578 - DNA, 557 bp, Homo sapiens
  misc_feature: GZ8MTXP02HE39W.19.71.G05.1.454.CMB.2.raw
  modified_base (238)..(238): a, c, t, g, unknown or other
  modified_base (312)..(312): a, c, t, g, unknown or other
  modified_base (366)..(366): a, c, t, g, unknown or other
  modified_base (421)..(421): a, c, t, g, unknown or other
  modified_base (438)..(438): a, c, t, g, unknown or other
  modified_base (555)..(555): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactcttagcttggtaccagcagagaccaggacagcctctaggctgctcatttacgnggctacgtccgtacccggacgtccgggtcccctagaccgtatcgaggtcggcgngggtcgggtcgtacgggactagtacttcacttcctaccactatcacgcacgtccngacgaggctagaaagtntggtcggtattagtttattatgtaacaaataattatttattatacgttgtacggtacgttacgaacgtaaaggacgtaacggtgtaatagaacgaacgacgtacgtgtcgacgtacncg

SEQ ID NO: 430579 - DNA, 537 bp, Homo sapiens
  misc_feature: GZ8MTXP02H0YQ1.19.71.G05.1.454.CMB.2.raw
  modified_base (242)..(242): a, c, t, g, unknown or other
  modified_base (320)..(320): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccaccatcaactgacaagtccagccaacaattcttttanacagttaccaaacaaatagaaaactacttagcttaggtaccagcagagaccaggacagcctcaggctgctcatttacnggacactcgtacccggatccccggggtccctgaccgattcgagtggcaggcggtcgtgggactagtactttcactctacaccatcagcagcctgacagctagaagatggtaggactagtttattattagtactaaataattattattattacttcgtagtacgttcggacgaacggtacgaggtagaataagtcgaacgacgtaactgtagtctacg

SEQ ID NO: 430580 - DNA, 584 bp, Homo sapiens
  misc_feature: GZ8MTXP02IA89W.19.71.G05.1.454.CMB.2.raw
  modified_base (229)..(229): a, c, t, g, unknown or other
  modified_base (344)..(344): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaagccctgcagaccctctcgctcacctgtcgccatcgtccgggganagagtcgctagcgacagtgtgcttggcacgtggtcaggcagtccccatcgagaggtctagagtggctgggaagacagtattcatgtaccaaacacgtaggaactacaaaatttanacgacactatctgttagagtagtacgatagaacaactacaaacgtagacaacagtaacgaaacgtaactacgttacctaccgtgacacgtcgtacgtacctcgtacgtacgaccgtaccggaggacgtacgggttagtaagtacgttacgtaggtacggtaacgaaccggacccctaagtacgaacctacgtaccgtaacccgtaccgttaccgttccttcgtacggtacgtacgttacg

SEQ ID NO: 430581 - DNA, 560 bp, Homo sapiens
  misc_feature: GZ8MTXP02JRH4Y.19.71.G05.1.454.CMB.2.raw
  modified_base (243)..(243): a, c, t, g, unknown or other
  modified_base (320)..(320): a, c, t, g, unknown or other
  modified_base (371)..(371): a, c, t, g, unknown or other
  modified_base (435)..(435): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccgatacaactgacaagtccagccacaattcttttanacagttaccaacaatagaaaactcttagcttggaccagcagacgaccaggacagcctcctaggctgctcatttacgnggacatccgtacccgggatccggggtcccctgaccgtattccgaggtcgcnggtcgggtactggggaccagtactttcactctcaccatcagcacgcctagccaggctagaaagngtgtggactaggttttataattcgtaactaataattattaatttatacgtttgtacggtacgttcggaccgtaacgggaacctaggacgtatataacgaagaccgtaagttgcggactcggaacc

SEQ ID NO: 430582 - DNA, 504 bp, Homo sapiens
  misc_feature: GZ8MTXP02FH943.19.71.G05.1.454.CMB.2.raw
  modified_base (237)..(237): a, c, t, g, unknown or other
  modified_base (312)..(312): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttacnggcatctaccgggaatccggggtcccctgaccgattcagtggcagcgggtctgggacagatttcactctcaccatcagcagcctgcaggctgaaagatgtggctagtttattattgtacaactaatattatatactcgtgacgttcggactaaagggaccaaggtgatatcgagacgaactgtaggctgacc

SEQ ID NO: 430583 - DNA, 653 bp, Homo sapiens
  misc_feature: GZ8MTXP02JAN03.19.71.G05.1.454.CMB.2.raw
  modified_base (317)..(317): a, c, t, g, unknown or other
  modified_base (326)..(326): a, c, t, g, unknown or other
  modified_base (399)..(399): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccacgtccgtccggggacagagtcgctagcgacagtgttgcgttggcacgtgggtcaggcacgtccccagtcggagnggtctaggnggtggcgtaggggaagactagttactttcgagttcgtaccaaacgtacggtaggtaaactaacgtaaatttancgaccacctattcgtagttagaagtacgtacgacgtagaacaactacgaaacgtacgaacacgaagtaaccggaaacgtaaaccctacgttacccgtcccgtagaccgacgtccgtacgtacccttcgtacggttaccgacccggtacccgggaaacgggtaccggttaaacgggggttatttaaacgtttaacgtttaacggtacggggttaacgggaaaccggtacccggaaccccctaaaggtaaacccgg

SEQ ID NO: 430584 - DNA, 573 bp, Homo sapiens
  misc_feature: GZ8MTXP02GO7UI.19.71.G05.1.454.CMB.2.raw
  modified_base (239)..(239): a, c, t, g, unknown or other
  modified_base (313)..(313): a, c, t, g, unknown or other
  modified_base (358)..(358): a, c, t, g, unknown or other
  modified_base (419)..(419): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccacaattctttaanacagttaccaacaatgaaaactacttagcttggaccagcagagaccaggacagcctcctaggctgctcatttcngggcatcctaccgggaatccggggtcccctgaccgattcagtgcnggcgggtctggggacagtatttcactctcaccatacagcagccctgccaggctaggaaagntggtggtactaaggttttattaagttcgtacaaacttaattaatttaatttaactactttacggtacggtacgtttacgggacgtaaacggggacctaaagggttaggaatttagaaccgaaggtacgtaacgttaggtacggcttaggaaccc

SEQ ID NO: 430585 - DNA, 608 bp, Homo sapiens
  misc_feature: GZ8MTXP02FVZXD.19.71.G05.1.454.CMB.2.raw
  modified_base (240)..(240): a, c, t, g, unknown or other
  modified_base (320)..(320): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccacaattctttanacagttaccaacaatagaaaactacttagcttggtaccagcagagaccaggacagcctacgtaggctgcttcatttacgngggctactccgtacccggggaatcccggggtcccctagaccgtattccgaggtcggcagggccgggtctaggggacctagtactttccactctacacccatcagccacgccctgaccgagggactaggaaagtagttcggtaggtacttagttttaacttattacgtaacctaaacttaattaatttattaacttaccgttggtacggtaccgttcggaacccgtaaagggaccgtaaagggtacgaattacgaacgtaaggacgtaacgtggtaacggctcgaaccg

SEQ ID NO: 430586 - DNA, 492 bp, Homo sapiens
  misc_feature: GZ8MTXP02IJYPL.19.71.G05.1.454.CMB.2.raw
  modified_base (228)..(228): a, c, t, g, unknown or other
  modified_base (238)..(238): a, c, t, g, unknown or other
  modified_base (246)..(246): a, c, t, g, unknown or other
  modified_base (258)..(258): a, c, t, g, unknown or other
  modified_base (265)..(266): a, c, t, g, unknown or other
  modified_base (270)..(270): a, c, t, g, unknown or other
  modified_base (276)..(276): a, c, t, g, unknown or other
  modified_base (278)..(278): a, c, t, g, unknown or other
  modified_base (280)..(280): a, c, t, g, unknown or other
  modified_base (286)..(286): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggcaccatcaactgcaagtccagccanaatcttttanacatcaanatagaaatatantgtacannaganacaganancncagctnctctattactggcatacgtaccggaacgtccggtccccgtcgacgatcagtgcgcgcggtcgtgggacagtattctactctcaccacacagcacgcctcgcgaggacgtagaaagaagtagtggtacgtagtttaatttaattagttactaaactaaattaaatttaatttaattaacgttacgttacggtacggttaccggtacc

SEQ ID NO: 430587 - DNA, 587 bp, Homo sapiens
  misc_feature: GZ8MTXP02IVJHA.19.71.G05.1.454.CMB.2.raw
  modified_base (237)..(237): a, c, t, g, unknown or other
  modified_base (313)..(313): a, c, t, g, unknown or other
  modified_base (427)..(427): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaacaatagaaaactacttagcttaggtaccagcagagaccaggacagcctctaggctgctcatttacngggcatcgtacccgggaatcccggggtcccctgacccgattcagtcggcaggcgggtctggggacaggtatttccacgtctcaccatacacgcagcctgcaggctgaaagatgnggtctagtttatattgtactaaactaattaattaattaactacgttacggtacggtacggtttaccggaaccgtaaagggggtaaccctaaaggggtaggtaacttaagtaaccgaaaggtaaaccggtaaaaccgtggtaacgggtcttaacggtaccc

SEQ ID NO: 430588 - DNA, 526 bp, Homo sapiens
  misc_feature: GZ8MTXP02F5426.19.71.G05.1.454.CMB.2.raw
  modified_base (282)..(282): a, c, t, g, unknown or other
  modified_base (288)..(288): a, c, t, g, unknown or other
  modified_base (316)..(316): a, c, t, g, unknown or other
  modified_base (333)..(333): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagtgttgcttggcacgtgggtcaggcagtccccatcgagngtcagngtgctggaagcagtattcatctaccaanacgtgaatacaaattangcaccatctgtgagtagtcgaactgaacaatacaatagacacatacgaacgaaccagttctacctgacagctacgacctctgtacgacctccgacgacgtacggttagttactacgtgtacggtaagaccgaccccgaatacgacacgtacgacctaaccgtccgtacgtccgtggtcgtacgttagtaacgg

SEQ ID NO: 430589 - DNA, 539 bp, Homo sapiens
  misc_feature: GZ8MTXP02GKANK.19.71.G05.1.454.CMB.2.raw
  modified_base (397)..(397): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttgcactgggtcaggcagtccccatcgagaggtctagagtggcgtgggaacgacagtatttcatcgtacacacgtaggaaatacaaattatagacaaccattctgttagagagtacgactagacaanacaacgtaagacaacatacgaaacgaacctacgttacctccctgcaacgctacgtacctctacgtcgacctccccggaggacgtacgggtacgttaattaacttaacgtggtaggaaacggaccggtaccccaatagaaccg

SEQ ID NO: 430590 - DNA, 582 bp, Homo sapiens
  misc_feature: GZ8MTXP02HPJV6.19.71.G05.1.454.CMB.2.raw
  modified_base (246)..(246): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactgacaagtccagccactaattcttttaanacagttacccaaacaaatacgaaaactacttagcttaggtaccagcagacgaccgaggacacgcctaccgtaggctgctctatttactgggcacgtccgtaaccccggggaactcccgggggtcccccctaggtacccgtatttccgaggttcggccagggtccgggtcgtggggacctaggtactttcactctcacccataccagcagcctgcgagctagaagatgcggtatagttttatattgactaataattattatactagttcgtgacggtttcgaccgtaaaggtacaggtagtatataaccgagtaaccgtaactggtcggctagaacc

SEQ ID NO: 430591 - DNA, 586 bp, Homo sapiens
  misc_feature: GZ8MTXP02JYDZN.19.71.G05.1.454.CMB.2.raw
  modified_base (239)..(239): a, c, t, g, unknown or other
  modified_base (372)..(372): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaattctttanacagttccaacaatagaaactacttagcttaggaccagcagacgacaggacagcctcctaggctgctctatttacgtgggcagtaccgtacccggggaatccccggggtcccctgaccgattccaggtcggcngggcggggtctggggactagactttcgactctcaccctatcagcacgcctgcaggctagaaagtgtcggtggacttaggtttacttagttcgtacaaactaattatttaattataccgttagtacggtacgttccggacgtaaacgggaccgtaagggtacggtaattacgaacgtaacggaaaccgacgttaggttacggacccttaggaccc

SEQ ID NO: 430592 - DNA, 513 bp, Homo sapiens
  misc_feature: GZ8MTXP02IQO0J.19.71.G05.1.454.CMB.2.raw
  modified_base (322)..(322): a, c, t, g, unknown or other
  modified_base (340)..(340): a, c, t, g, unknown or other
  modified_base (350)..(350): a, c, t, g, unknown or other
  modified_base (361)..(361): a, c, t, g, unknown or other
  modified_base (380)..(380): a, c, t, g, unknown or other
  modified_base (389)..(389): a, c, t, g, unknown or other
  modified_base (422)..(422): a, c, t, g, unknown or other
  modified_base (443)..(443): a, c, t, g, unknown or other
  modified_base (481)..(481): a, c, t, g, unknown or other
  modified_base (488)..(488): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcagtccccatcgagaggtctagagtggctagggaagacattatttcatgtccaanacgtgaaatacaaattangcaccatctnttgagagtcangaacaatcaacgtagacanatacgaaanaactagttcctacctgctagctagactctgtanacgtcccgaggaccgtaggtntagtattactgaggtaaagccgaccccaatacgacaancgaaccnccgtacgtctcgtggtacgtctaag

SEQ ID NO: 430593 - DNA, 533 bp, Homo sapiens
  misc_feature: GZ8MTXP02IZ2TA.19.71.G05.1.454.CMB.2.raw
  modified_base (387)..(387): a, c, t, g, unknown or other
  modified_base (439)..(439): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctccactgtcgccatcgtccggggacagagtcgctagcgacagtgttgcttggcacgtgggtcaggcacgtccccatcgagaggtctaggagtggcgtagggaagacagtattcatcgtaccatacgtaggaaactacgtaattatgacaaccatctgtgagngtacactagacaatacaagtagacacaagtacgaaactaccacgtcctccgngtacacgctcgactcgtcgacgacctccggacggtacgtacggtacgtaattacgttaacgtaggtacggaacgaccggacccctagtacgacc

SEQ ID NO: 430594 - DNA, 573 bp, Homo sapiens
  misc_feature: GZ8MTXP02HVIGK.19.71.G05.1.454.CMB.2.raw
  modified_base (241)..(241): a, c, t, g, unknown or other
  modified_base (304)..(304): a, c, t, g, unknown or other
  modified_base (309)..(309): a, c, t, g, unknown or other
  modified_base (317)..(317): a, c, t, g, unknown or other
  modified_base (367)..(367): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccacaatcttttanacagttccaaacaatagaaaactactagcttggtaccagcagagacaggacagcctctaggcngttcncatttacnggcatccgtacccgggaatccggggtaccccctgacccgtatcagtggcnggcgggtctgggaccagtactttcgactctcaccgtatcagcagcctgcgaggctagaaagtagtggtagggtacttaagttttattagttgtaccaaattaaatatttaattatacgttacgttacggtacgtttcggaaccgtaaaggggtaacctaagggtacgtatagtaaccgagaacgtaacgtgtacggctacggaacc

SEQ ID NO: 430595 - DNA, 591 bp, Homo sapiens
  misc_feature: GZ8MTXP02HO39N.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccagtcgagaggtctagagtggcgtaggggaacgactagttatttcattcgtaccacgtacggtaggaaattaactaaattatgaccaacctatcgttgttagagtagtcgactagaacaatacgaaacgtagaacaacaactacgaaagtaacctacgttacctccctagactacgctacgaccttcgtacgtacgtaccgtacccggacggtaaccgtaccggggtagttaacgttacgtttaacgtaggtaacgggtaacggaaccggtacccccaagttaacggtaaccg

SEQ ID NO: 430596 - DNA, 664 bp, Homo sapiens
  misc_feature: GZ8MTXP02G069O.19.71.G05.1.454.CMB.2.raw
  modified_base (383)..(383): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacaggagtcgctagcgacagtgttgctggcacgtggtcaggcacgtccccatcgagaggtctagagtggcgtggggaagactattatttcagttgtacccaaacacgtaggtaaactaacgtaaaatttanacgtaccaacctattcgttaggttagaagtagtaccgtaactacgaaactaaagtaccgaaaacggtaacaaccaacgtaaacgtaaccggaaaacgtaaacccctacgttacccctcccgtaggacctaacggtccttaccgtaacccttcgttacggttacgaacccccggttacccgggaaacggtaacccgggtaacggggtttacgttaaacgtttaagtttacccggtaggtaacgggaaaaccggacccggggtaacccccgtaataaaaccgg

SEQ ID NO: 430597 - DNA, 546 bp, Homo sapiens
  misc_feature: GZ8MTXP02GW6CK.19.71.G05.1.454.CMB.2.raw
  modified_base (242)..(242): a, c, t, g, unknown or other
  modified_base (314)..(314): a, c, t, g, unknown or other
  modified_base (323)..(323): a, c, t, g, unknown or other
  modified_base (360)..(360): a, c, t, g, unknown or other
  modified_base (413)..(413): a, c, t, g, unknown or other
  modified_base (431)..(431): a, c, t, g, unknown or other
  modified_base (437)..(437): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccatggggacatcgtgatgacccagtctccagactccctggctgtgtctcgtgggcgagcgggccaccgatacaactgacaagtccagccactaatctttanacagttaccaaacaatagaaaactactagcttaggtaccagcagagtaccaggacagccctctaggctgctnaatttacgngggcatccgtaaccccggggatccccccggggtaccngaccgtattcgagtgcagcgggtctgggacagtatttcactctcacactcgancagcctgcgagctagaanatgtgntagttatattagaaactaataattattaatacgttcgtaggacgtttcgacgtaaacggaccgaacggttagattaagtaagaagtaccgaaactggtagactgaaccc

SEQ ID NO: 430598 - DNA, 515 bp, Homo sapiens
  misc_feature: GZ8MTXP02IGIY6.19.71.G05.1.454.CMB.2.raw
  modified_base (286)..(286): a, c, t, g, unknown or other
  modified_base (333)..(333): a, c, t, g, unknown or other
  modified_base (442)..(442): a, c, t, g, unknown or other
  modified_base (483)..(483): a, c, t, g, unknown or other
  modified_base (509)..(509): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcactgggtcaggcagtccccatcgagagtcagngtggctgggagacatatttcatgtaccaacagtgaactacaaattangacaccatctgttgagtagtcgactgaacaatcaacgtagacacatacgaagaacagttcctcctgacagcctcgacctcgtgtcgaccgtaccgaggacgtacgggtntatacgttactaggtaggaacgacggtaccccaatacgacntacgcctacctcgtctcgtcggtacncttaag

SEQ ID NO: 430599 - DNA, 595 bp, Homo sapiens
  misc_feature: GZ8MTXP02HOQG7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccggggacagacgtcgctagcgacagtgtgcgttggcacgtgggtcaggcacgtccccatcggagaggtctagaggtggcgtaggggaaaggactatatttcatcggtccaaacgacgtaggaaataacgtaaaatttatacgacctaacctaattcgtaggttagaagtacgtacgaactagaaactatacgaaacgtagaacaacataacgaaacgaaacctagttaccaccctaggacaacgtcctacgaccttcgtacgtacgaaccgtacccggaaggaccgtacggggttataacgttaacgttacgtaggtacggaaaccgacccggtacccctaaagtaaccg

SEQ ID NO: 430600 - DNA, 590 bp, Homo sapiens
  misc_feature: GZ8MTXP02HO7UA.19.71.G05.1.454.CMB.2.raw
  modified_base (317)..(317): a, c, t, g, unknown or other
  modified_base (349)..(349): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatcgtccggggacagagtcgctagcgacagtgttgcttggcacgtgggtcaggcacgtccccagtcgagaggtctagngtggcgtagggaagacatattcagtgtccaanacgtagaataacaaattatgacacctattcgtagttgagtacgtcgaatcgaacaatacaaacgtagaacacgtatacgaaagaacctaacgttcctccgtagacacggtcctacgtaacccttcgtacggtacgtacccgttacccggaacgggtaaccgtaccgggggttattaaacgtttaacgtttaaccgtagggttacgggaaaacggtacccgggtaccccctaaataaaccgg

SEQ ID NO: 430601 - DNA, 554 bp, Homo sapiens
  misc_feature: GZ8MTXP02F40JA.19.71.G05.1.454.CMB.2.raw
  modified_base (213)..(213): a, c, t, g, unknown or other
  modified_base (224)..(224): a, c, t, g, unknown or other
  modified_base (231)..(231): a, c, t, g, unknown or other
  modified_base (239)..(239): a, c, t, g, unknown or other
  modified_base (243)..(243): a, c, t, g, unknown or other
  modified_base (260)..(260): a, c, t, g, unknown or other
  modified_base (275)..(275): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctctgggcgagcgggcacgacacgacnacagtcagcanatcttanacatacanatanaactctagctcgtacanacagagacagacacnctcgtcgctctctactactacgtcgactacgtacgtaccggtacgtccggtcccgtacgacgtactcgcgtcgacgcgtcggtcgtcgacgtagtactactactactacacactacacgacgacgcgtcgacgacgacgtacgagtagtagtacgtagtagttagttatactactaactaataattattactacgttacgtacgtacgtacgtacgtaacggtaacgtacgtacgtagtacgtaacgtacgtacgtacgtacgtacgtacgtacgtacg

SEQ ID NO: 430602 - DNA, 573 bp, Homo sapiens
  misc_feature: GZ8MTXP02F26KS.19.71.G05.1.454.CMB.2.raw
  modified_base (238)..(238): a, c, t, g, unknown or other
  modified_base (312)..(312): a, c, t, g, unknown or other
  modified_base (377)..(377): a, c, t, g, unknown or other
  modified_base (426)..(426): a, c, t, g, unknown or other
  modified_base (437)..(437): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccacaattctttanacagttccaaacaatgaaaactcttagcttggaccagcagagaccaggacagcctcctaggctgctctatttcngggctatccaccggggaatcccggggtcccctaggacccgattccgagtcggcagggtccgggtntaggggaccaggtatttccgactcgtacacccatcagtcagccctgacnggactgaaagntggtcggatagttttacttattacgtactaaataattattaattagttacttcggtagggtacgtttcggacgtaaacgggtaccgaagggtacgattaagaacgtaagaaccgtaacgtggtaggactcggaacc

SEQ ID NO: 430603 - DNA, 521 bp, Homo sapiens
  misc_feature: GZ8MTXP02GY1FO.19.71.G05.1.454.CMB.2.raw
  modified_base (343)..(343): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccatcgagaggtctagagtggcgtgggaacgacatattcatgtaccanacgtaggaatacaaattatgacaccatctagttgagagtcgactgacaatacaacgtagacacatacgaaacgaactagttcctacctgcaacgcttacgacctctcgtagtaccgtacccgaggacgtacgggtcgtaatacttaacgtagtaggaacgacggaccccagtacgaac

SEQ ID NO: 430604 - DNA, 576 bp, Homo sapiens
  misc_feature: GZ8MTXP02I407G.19.71.G05.1.454.CMB.2.raw
  modified_base (239)..(239): a, c, t, g, unknown or other
  modified_base (319)..(319): a, c, t, g, unknown or other
  modified_base (417)..(417): a, c, t, g, unknown or other
  modified_base (420)..(420): a, c, t, g, unknown or other
  modified_base (430)..(430): a, c, t, g, unknown or other
  modified_base (434)..(434): a, c, t, g, unknown or other
  modified_base (437)..(437): a, c, t, g, unknown or other
  modified_base (456)..(456): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccaacaatctttanacagttccaaacaatagaaaactcttagcttaggtaccagcagagaccaggacagcctccgtaggctgctacatttacgnggctagtccgtacccggggaatcccggggtcccctagaccgtattcgagtcggcagggtcggtacgtaggggactagtactttcactctcaccatcancancctgcaggcngaantgnggcttagtttatatcgtanaaactaattaattattaatacgttcggtacgtacgttccggaccgtaaaagggtacctaagggtacgtaagttacgtaacgaaacggtaacgtaacgttggtacggtcgttacggaaccc

SEQ ID NO: 430605 - DNA, 646 bp, Homo sapiens
  misc_feature: GZ8MTXP02JLXVI.19.71.G05.1.454.CMB.2.raw
  modified_base (239)..(239): a, c, t, g, unknown or other
  modified_base (316)..(316): a, c, t, g, unknown or other
  modified_base (370)..(370): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgaccagtctccagactccctggctgtgtctcgtgggcgagcgggccaccatcaactgacaagtccagccacaattctttanacagttccaacaatgaaaactactagcttaggtaccagcagagaccaggacagcctctaggctgctcatttaccggnggctacgtccgtaccggacgtccgggtcccctagaccgtattcgaggtcgacgngggtccgggtcgacgggactagttactttacactctaccactactacgacgccgacgtccgtagaccgaggtacgtagaaacggtagttacggtacggtatttaaggttttaacgttagttacgttaactaaacttaagtttaactttaacgttaacgttaccgtttacgggttacggttaccggttacgggaaaccggtaaacggggtaaaccgtaagggtacgtaatacgtaaccgaaacgtaacggtaacgtcggtacggtacgtacgtaccg

SEQ ID NO: 430606 - DNA, 693 bp, Homo sapiens
  misc_feature: GZ8MTXP02JGGW9.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatccgtccggggacagagtcgctagcgacagtgttgcttggcacgtggtcaggcacgtccccatcgagaggtctaggagtggcgtaggggaagactagttatttcagttcgtaccaaacgacggtaggaaaactaactaaaagtttatacgacctaaccctaattccgttgttaacggaaggtacgttccgtaaacgttacggaaacctaaaacgttaccgtaaaacggttaaacgaaacctaaacctaaacgttaaccggaaaacgtaaaaccccgttaacggtttccccttacccccgttagaaccgtaacggtaccgttaccggtaacccttcgtacggttaccgaacccgtacccgggaacgggtaccgtacgggttagttaacttacgttacgtaggtacgggaaacgaccgggacccctaaagtacgacacgtaccgccctaccgtcgtacgtcgtaggtcgtacgttaacgg

SEQ ID NO: 430607 - DNA, 737 bp, Homo sapiens
  misc_feature: GZ8MTXP02HR3LD.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagtgtgcgttggcacgtgggtcaggccacgtccccagtcgagtacggtctaggaggtggacgtaggggaagactattactttcattcgtaccaaacgtaacggtagaaacttaacgtaaaatttatacgactaaccgtacttacgtaggttaggaacgttacggttaccggtaacttacggaaactaaacgttaaccgtaaaaccgggttaaacaaaccgtaacgtaaacgttaaaccggaaaaccggtaaaaccccgttaacggtttccccttaaccccgttacggtaccgaaccggtaccttaccgggtaacccctttacggttacggtttaacccggaacccgttaacccccggggaaacgggtaacccgggttaacgggggttaactttaaacgttaaacgtttaccggtaacgggttaacgggaaaaccggtaccccggaacccccgttaaaggtaaacccg

SEQ ID NO: 430608 - DNA, 576 bp, Homo sapiens
  misc_feature: GZ8MTXP02IPE1K.19.71.G05.1.454.CMB.2.raw
  modified_base (238)..(238): a, c, t, g, unknown or other
  modified_base (316)..(316): a, c, t, g, unknown or other
  modified_base (378)..(378): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttaggtaccagcagagaccaggacagcctcctaggctgctcatttacnggcacgtccgtaccccggggaaatcccggggtcccccctggacccgtattccgagtcggccnggccgggtctaggggactagtactttcactcctcacctatcagctacgccctgcaagggctaggaaagtagtggtacggtacttagttttattagtttacgtacaaataattaatttatttaatacttcgttaggacgtttcggacgtaaagggacctagggtacgtatagtaacgagaacgtactggagtctagacc

SEQ ID NO: 430609 - DNA, 515 bp, Homo sapiens
  misc_feature: GZ8MTXP02FQITK.19.71.G05.1.454.CMB.2.raw
  modified_base (478)..(478): a, c, t, g, unknown or other
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatcgtccggggacagagtcgctagcgacagtgttgcttggcacgtgggtcaggcagtccccatcgagaggtctagagtggctggggaagacagtatttcatgtccaaacacgtaggaaatacaaattatgcacatctgttgagtagtcgactagacaaatcaaacgtagactaacagtacgaaaagaacccagttcctaccctagcagctgacctctgtgacctcccgaggacacgggtntactaattacgtagtaggaagacggaccccagtaacg

SEQ ID NO: 430610 - DNA, 637 bp, Homo sapiens
  misc_feature: GZ8MTXP02HNMR3.19.71.G05.1.454.CMB.2.raw
  modified_base (226)..(226): a, c, t, g, unknown or other
  modified_base (235)..(235): a, c, t, g, unknown or other
  modified_base (244)..(244): a, c, t, g, unknown or other
  modified_base (248)..(248): a, c, t, g, unknown or other
  modified_base (254)..(254): a, c, t, g, unknown or other
  modified_base (306)..(306): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccanaatctttanacatacaanatanaaactntagctagacagcagacgacagacacgcctacgtagctgctactagtttacgngggactacgttaccgtaaccgggtacgtcccggggtacctacgaccgtagttcgaggtcggacgagggtccggggttacgtagggaactagttacgtttccacttcctaccacctatacgacgacacgtccgtacgacgacggtacgtagaaagtagttggtacggtactttaagtttagttagttacgtaaactaaacttaatttaatttaattaacgtttacgttacggttacggtaccggtttacggaaccgtaaacgggtaacgtaacgggttacgaacttaacgtacgaaacgtaacgtaacgttcggacgtacgtacgtactacg

SEQ ID NO: 430611 - DNA, 641 bp, Homo sapiens
  misc_feature: GZ8MTXP02H7OR5.19.71.G05.1.454.CMB.2.raw
  modified_base (254)..(254): a, c, t, g, unknown or other
  modified_base (270)..(270): a, c, t, g, unknown or other
  modified_base (320)..(320): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtggggcgaggccggggcctacggactacggacgtcgactaaggtccagccacaattctttanacacgtaccaatatanaactactatactcgtacagacagacgacgacgacacgcctcgtacgctcnctactacttacgtacgcacgtaccgtaccggtaccggtccggtccccgtacgaccgtacgtacgtacggtcggcgcggtcgggtacggtacggacgtacgtacttactactcctcaccactacgacgacgacgccgtcgacgacgtacgtacgtaagtagtaggtacgtacgttagtttagttagttacgtaactaaactaattaatttaattacttacgttacggttacggttacggttaccggtaccggtaaacgggtaacggtacggtacggtagtacgtaacgtaacgtaacgtacgtacggtacgtcgtacgtacg

SEQ ID NO: 430612 - DNA, 563 bp, Homo sapiens
  misc_feature: GZ8MTXP02I9G6N.19.71.G05.1.454.CMB.2.raw
  modified_base (369)..(369): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccactcgtccggggacagagtcgctagcgacagtgtgcttggcacgtggtcaggcacgtccccatcgagaggtctagagtggcgtgggaagactatatttcattgtccaacacgtaggaataacaaattangacacctatctgtagagagtcgactagaacaatacaaacgtagaacacaataccgaaaagaaccctagttccctaccgtcgacgacgcctacgaccccttgtacgtacgtacccgtacccggaaacgggtaccgtacggggttattaacgttaacgttacgtaggtacggaaaccgccggaccccctaagaacg

SEQ ID NO: 430613 - DNA, 637 bp, Homo sapiens
  misc_feature: GZ8MTXP02G5S08.19.71.G05.1.454.CMB.2.raw
  modified_base (307)..(307): a, c, t, g, unknown or other
  modified_base (316)..(316): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgactagtgtgcttggcacgtggcaggcacgtcccatcgagnggtctaggngtggcgtaggggaagactagtatttcgattcgtaccaaacgacggtaggaaataactaaatttacacgaccacgtattcgtaggttacgaaggtacgtacgaactacgaaactaaacgtacgtaaaacggttacgaaacctaacgtaacgtaacggaaaacgtaaacccgtacggttacccttacccgttaggacctacgtacctttaccgtacgttacgtacgtaacccgttcccggaaacggtacgtaaccgggtagttaacgttacgttaaccggtaggtacggaaacggacccggtaccccgtaagtaacgtaaccg

SEQ ID NO: 430614 - DNA, 595 bp, Homo sapiens
  misc_feature: GZ8MTXP02JEOT1.19.71.G05.1.454.CMB.2.raw
  modified_base (234)..(234): a, c, t, g, unknown or other
  modified_base (310)..(310): a, c, t, g, unknown or other
  modified_base (360)..(360): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtcagccacaatctttanacagttccaacaatgaaaactctagcttaggtaccagcagagaccaggacagcctcctaggctgctcatttacggnggactacgtccgtaccggacgtccggtcccctgacgtatcgagtcggcgngggtcgggtcgtcgggactagtactttcactcctaccacctactcgacgcgacgcctcgcgacgtacgtagagtagtggtgtagttagtttagttagttacgtactaactaattaatttaattacgttacgttacggttacggttacggttaccggtaccggtaaacggtaacggtaacggtacggtaagtacgtaacgtacggtaacgtacgtacggtacggtacgtacgtacg

SEQ ID NO: 430615 - DNA, 555 bp, Homo sapiens
  misc_feature: GZ8MTXP02FOPX9.19.71.G05.1.454.CMB.2.raw
  modified_base (238)..(238): a, c, t, g, unknown or other
  modified_base (318)..(318): a, c, t, g, unknown or other
  modified_base (373)..(373): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttccaaacaatagaaaactacttagcttaggtaccagcagacgaccaggacagcctcctaggctgctcatttacgnggcatccgtacccggggaactcccggggtccccctagacccgatttcaggtggcnggcgggtcgtgggacagtatttcactctcacctatcagcagcctgccagactagaagatggtgctagtttatattgacaataattattaattatacgttcggtaggtacgttcgggaaccgtaaagggacctaaggtacggtattaagaacgtaagaacgtaacgtggtacgacgtgaaccc

SEQ ID NO: 430616 - DNA, 668 bp, Homo sapiens
  misc_feature: GZ8MTXP02HRRAN.19.71.G05.1.454.CMB.2.raw
  modified_base (244)..(244): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctctgggcgagcgggccaccatcaactgacaagtccagccactaattcttttaanactacttaccaaataataagtaaaactacttagtcttacggaccagacaagacgaccgaggacacgcctacgtaggctgtctacttaagtttacgcggacctacgttacccggtaaccccggggtaacgttccccggggtacccctacggaccgtagttccggaggtcggacgtggggtccgggtacgaggggacctagttactttcacctcctaccacctatacacgacacgtcgtcgacgacgacgtagaagtagtgtaggtagttagtttattattagtaactaaactaaattaatttaatttaacttacgttacggttacggttacggttaccggtaaccggtaaacgggtaaacggtaacggtaacggtaagtaacgtaacgtaacgtaacgtaacgtacggtacggtacgtacgtacg

SEQ ID NO: 430617 - DNA, 552 bp, Homo sapiens
  misc_feature: GZ8MTXP02GDUSK.19.71.G05.1.454.CMB.2.raw
  modified_base (347)..(347): a, c, t, g, unknown or other
  modified_base (366)..(366): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgtgcttggcacgtgggtcaggcacgtccccatcgagaggtctagagtggctggggaaagctatatttcatgtccaanacgtagaaatacaaaattntgacaccatctagttgagagtcgactagaacaaatacaaacgtagaacaacatacgaaaacgaacctaacgttacctacccgtcgaccagacctacgtaccttcgtcgtacgaaccgttacccggaacggacgtacgggtagttaactaattacgtacggtaggaacgacggacccccagtaaacg

SEQ ID NO: 430618 - DNA, 659 bp, Homo sapiens
  misc_feature: GZ8MTXP02G4NZ1.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcacgtccccagtcgagaggtctagagtggcgtaggggaacggactatatttcattcgtaccacgtacggtaggaaataacgtaaaatttagtacgacctaacctattccgttagttagaacggtagtaccgaacttacggaaacaaattaccgaaaacgttaagaacctaaacaacgttaacggaaacgaaacccgtaacggtttccctaccccgttagacctaacggtcttacggtaacccttcgttaggtaccgtaaacccggttccccgggaaagggaaccgttaacgggggttacttaaacgtttacgtttaaccggtagggttaacggggaaaacggtacccggaccccctaaggttaacgtaaccg

SEQ ID NO: 430619 - DNA, 701 bp, Homo sapiens
  misc_feature: GZ8MTXP02HESUU.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccacgtccgtccggggacaggacgtcgctagcgacagtgttgcgttggcacgtgggtccaggccacgtccccagtcggagaggtcaggtaggtggcgtaggggaacgactagttactttacgagttcgtaccgaaacgtacggtaaggtaaacttaaactaaaagtttactacgacctaaccgtattacgttaggtttaggaagtacggtaccgacgttaacgaactaaacgtacgtaaaacggttacgaaacaccgtaaagttaccgggaaaacggtaaacccttaacgttaccccgttacccgtagaccgtaacgtaccgtacggtacccttaccgtcggtaccgtacccgttaccccgggaacgggtaacccgggtaacggggttacgtttaacgttaaccgttaggttacggggttaacgggtaaaaccgggcccggtaacccccgaagtaaacccgg

SEQ ID NO: 430620 - DNA, 520 bp, Homo sapiens
  misc_feature: GZ8MTXP02FKURL.19.71.G05.1.454.CMB.2.raw
  modified_base (369)..(369): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggctggggaagacatatttcattgtccaacgacgtaggaaatacaaatttangacacatctagttgagagtacgactagacaatacaaacgtagacacatacgaaacgaacctacgttacctccctgcagctcgacctctcgtcgacgtacccgacggacgacgggtgtataagttacgtaggtacggacgacgacccatacg

SEQ ID NO: 430621 - DNA, 595 bp, Homo sapiens
  misc_feature: GZ8MTXP02IC8G4.19.71.G05.1.454.CMB.2.raw
  modified_base (325)..(325): a, c, t, g, unknown or other
  modified_base (544)..(544): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagacgtcgctagcgacgagtgtgcgttggcacgtggtcaggcacgtccccagtcgagagtctagagtcggngtacggggaagactagttattcagttcgtaccaaagtacgtaagtaaactaaactaaaatttactacggacctaaccaagttccgttaggttagagtacgtcgaactcgaaactatacgaaacgtagacactaagtacgaaacgacctagtccctacctgtacacgtcgtacgaccttcgtagtccgaccgtacccggaaggtaccgtaccgggtttanaaacgttaacgttacgaggtaacggaacgtacccggaccccgtaagaaccg

SEQ ID NO: 430622 - DNA, 718 bp, Homo sapiens
  misc_feature: GZ8MTXP02HQS0O.19.71.G05.1.454.CMB.2.raw
  modified_base (233)..(233): a, c, t, g, unknown or other
  modified_base (306)..(306): a, c, t, g, unknown or other
  modified_base (316)..(316): a, c, t, g, unknown or other
  modified_base (363)..(363): a, c, t, g, unknown or other
tcagtactctcgtgcacgaccggtgctcgatttagtgtcgtcgcaagagagaggggggtacaacaggcaggcagggcagcaagatggtgttgcagacccaggtcttcatttctctgttgctctggatctctggtgcccacggggacatcgtgatgacccagtctccagactccctggctgtgtctcgtgggcgagcggcacgatcaactgacaagtccagccatattctttanacagttaccaataatgaaaactctagcttggaaccagcaagtacgaccaggtacagcctcctaggctgacttnaatttacggnggtactacgtaccggtaaccggtacgtccgggtaccacgtaaccgtnttcgaggttggaccgtagggtccgggttacgtacgggaactacgttacttccgaccttcctacctaacgtacgtaccgaacgaccgtaaccgtcccgtacgtacgtacggtacgtacgtaagtaggttacggttacggttacgtttaagtttaagtttaacgttaacgttaacgtaaacgttaaacgttaaacgtttaaacgtttaacgtttaacgtttacggttacggttaaccggttaaccgggttaaaccggtaaacgggtaaaccgggtaaacgggttaacggtaacgttaacgtaacgtaaacggtaaacggtaacggttacggtacggtaccggtaccgtaccgtaccg

SEQ ID NO: 430623 - DNA, 673 bp, Homo sapiens
  misc_feature: GZ8MTXP02ID7Q6.19.71.G05.1.454.CMB.2.raw
  modified_base (249)..(249): a, c, t, g, unknown or other
  modified_base (335)..(335): a, c, t, g, unknown or other
  modified_base (386)..(386): a, c, t, g, unknown or other
  modified_base (401)..(401): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccgatacgaactgacaagtccagccaactaattcttttaanactacgttaccaaataataacgtaaaactactagcttacgaccagacagacgaccagacacgcctcgagctgctactagtttacgnggactacgtacccgtaacccgggacgtccccggggtccccctacgaccgtnttacgaggtcggacncgggtcgggtactacggggactagttactttacacttcctaccaactactacagtacgctagcaggctagaagtgtggtaggtactttaagttttattacgttagtaactaaacttaaatttaatttaacgttaagtttaccgtttacggttacgggttaccggttacgggaaccggtaaaacgggtaaccggtaaagggttacgtaacgttaacgtaacggaaaacggtaacggtaaacggttcggtacggtaccgtacgtaccgtaaccg

SEQ ID NO: 430624 - DNA, 563 bp, Homo sapiens
  misc_feature: GZ8MTXP02GDU6O.19.71.G05.1.454.CMB.2.raw
  modified_base (242)..(242): a, c, t, g, unknown or other
  modified_base (322)..(322): a, c, t, g, unknown or other
  modified_base (397)..(397): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgacaagtccagccaacaattctttanacagttaccaaacaatagaaaactcttagcttaggaccagacagagaccaggacagcctcgtaggctgctctatttacgngggctatccgtaacccggggaatcccggggtccccctagacccgtattccgaggtcgcaggcgggtctggggacngtatttcactctcaccatcagtcacgccctagccagctagaaagatggtgactagtttatattcgtacaaataattattattaattacgttcgtaggtaccgttacggacgtaaacgggactaacgggttagattagaacgagaaccgtacgtgtcggactcgacc

SEQ ID NO: 430625 - DNA, 525 bp, Homo sapiens
  misc_feature: GZ8MTXP02J0BH2.19.71.G05.1.454.CMB.2.raw
  modified_base (236)..(236): a, c, t, g, unknown or other
  modified_base (302)..(302): a, c, t, g, unknown or other
  modified_base (309)..(309): a, c, t, g, unknown or other
  modified_base (338)..(338): a, c, t, g, unknown or other
  modified_base (354)..(354): a, c, t, g, unknown or other
  modified_base (373)..(373): a, c, t, g, unknown or other
  modified_base (378)..(378): a, c, t, g, unknown or other
  modified_base (406)..(406): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaacaatgaaaactcttagcttggtaccagcagagaccaggacagcctctaggctgctnattacgnggcatcgaccggatccccgggcctgaccntcagtgcaggcggtcngggacagtacttcacttcncaccntcagcacgctgcagtcaggaagtgtggngtacttaggtttatacgttgtaacaattaattatttactatacttggtaggtcgttacggaccaaagggtccaaaggttgaataaccgtacgaaggtaccgtagttcggtacggctacg

SEQ ID NO: 430626 - DNA, 652 bp, Homo sapiens
  misc_feature: GZ8MTXP02H2B08.19.71.G05.1.454.CMB.2.raw
  modified_base (240)..(240): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttaanactactaccaacaatagaaaactactagtcttagtacagacagacgaccagacacgcctcgtagctgctctatttacgtggctacgtaccgtaaccgggacgtcccggggtccccctacgaccgtattcgaggtcggcgcgggtcgggtcgtggggactagtactttcactctcaccatcacgcacgcctgacgacggactagaagtagtggtaggtacgttagttttaacttagttacgtaacaaacttaaatttaaagtttaactttacgttaaccgtttacggttaacggttaccggtttacccgggaaaccggtaaaacggggtaaaccggtaaaggggtacgttaaacgttaacgtaaccgtaaacggtaaaccggttaacgttacgggtacggtaccgtacgaccg

SEQ ID NO: 430627 - DNA, 586 bp, Homo sapiens
  misc_feature: GZ8MTXP02FQS4F.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctaggagtggcgtaggggaagactattatttcgattcgtacccaaacgacggtaggaaattaacgtaaaattatgaccactattctagttagaagtacgtaccgaaccgacaactacgaaacgtagaacaacatacgaaacgaacctagttcccaccgtgacctaagctacgaccttcgtcgtacgacccgtacccggaaaggtaccgtacggggttataacgttacgttaacgtacgggtacggaaacggaccggacccctaagtacggaaccg

SEQ ID NO: 430628 - DNA, 642 bp, Homo sapiens
  misc_feature: GZ8MTXP02J1HUL.19.71.G05.1.454.CMB.2.raw
  modified_base (157)..(157): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttactggcatctaccgggatccggggtcctgaccgattcagtgcagcggtctggacagatttcactctcacatcagcagctgcagctgaagatgtgcctagtttatagttgacaactaattatttaattaattacttcggtaggtaacgtttcgggaccctaaaggggaccaaaggttcggaatatacgagaacgtaacgtggtacgggtactacggacctaaaccttcgttaccgttcgttaccttaccgtaccctttccccgttacccccgtactacgttaccgtaaccgaacccgtaaacggaacgttaaccggttaaccggtacgggtaaccggggtaccggggttacgtaaccggggaacccggaaaccggggttacccgaacgtaacggtacggcgacgacgacgacgcg

SEQ ID NO: 430629 - DNA, 633 bp, Homo sapiens
  misc_feature: GZ8MTXP02F73LZ.19.71.G05.1.454.CMB.2.raw
  modified_base (240)..(240): a, c, t, g, unknown or other
  modified_base (251)..(251): a, c, t, g, unknown or other
  modified_base (318)..(318): a, c, t, g, unknown or other
  modified_base (382)..(382): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccacaattctttanacagttccaanaatagaaactactagcttaggtaccagcagacgaccaggacagcctcctaggctgctctatttacgngggcacttccgtacccggggaattcccggggtacccccctaggacccgtattcgaggtcggacncggggtccgggtacgtaggggacctaggttactttccaccgttcctacctaaccctatccagtcgacgtcctggaccgaggctaggaaagtgtggtacgtacgttaagttttatttagtcgtaacctaaataatttaattactttaagtttaccgttcggttacggtaccggttacggaccggtaaacgggaacctaaggggtagtagtacgtaaccggaacgtaacgtggtacggtcgtacgactaaccg

SEQ ID NO: 430630 - DNA, 691 bp, Homo sapiens
  misc_feature: GZ8MTXP02HOPOA.19.71.G05.1.454.CMB.2.raw
  modified_base (242)..(242): a, c, t, g, unknown or other
  modified_base (330)..(330): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcgggccaccatcaactgcaagtccagccaactaattcttttaanacacgttacccaaacaatacgtaaaactcttagcttacggaccagcagacgaccaggacacgcctccgtaggctgctactatttacgngggactacgtaccgtaaccccggggtacggttccccggggtaccccctacggtacccgtattaccggacggtcgggacgacggggtccggggttacgtacggggacctaggtactttccaccctacctaccaacctatacgacgtccacgtcccgtagaccgagggtacttaggaaagtgttggtaggttacgttaagttttatagttactaacgtaaattaatttatttaactttacgttaccgtttcggttacgggtaaccggtttacgggaaaccgtaaacggggtacgtaaacggggtgttaaacgtacgtaaccgaaaggtaaccggttaacgtggtacggtacgttacggaaccc

SEQ ID NO: 430631 - DNA, 613 bp, Homo sapiens
  misc_feature: GZ8MTXP02HYYZO.19.71.G05.1.454.CMB.2.raw
  modified_base (230)..(230): a, c, t, g, unknown or other
  modified_base (239)..(239): a, c, t, g, unknown or other
  modified_base (247)..(247): a, c, t, g, unknown or other
  modified_base (251)..(251): a, c, t, g, unknown or other
  modified_base (260)..(260): a, c, t, g, unknown or other
  modified_base (303)..(303): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcacgatacgaactgacaagtccagccanaatctttanacatcaanatanaaactatanctgacagcagacacagacacgcctcagctgctactatttacgnggactacgtccgtaacccgggaagtcccggggtcccctagaccgtattacgaggtcggacgcggtcgggtcgtacggacgtagtacgttactactactacacactacacgacgacgaccgtcgacgacgacgtagaagtagtagtaggtacgttagtttaagttagttagtactaaactaaattaactttaattaacttacgtttacgttacggtacggttacggtaaccggtaaacgggtaaacggtaaacggtacggtaagtaacgtaacgtaacgtaacgtaacgtacggtacggtacgtacgtacg

SEQ ID NO: 430632 - DNA, 616 bp, Homo sapiens
  misc_feature: GZ8MTXP02IHBRK.19.71.G05.1.454.CMB.2.raw
  modified_base (246)..(246): a, c, t, g, unknown or other
  modified_base (344)..(344): a, c, t, g, unknown or other
  modified_base (585)..(585): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatacaactgacaagtccagccactaattcttttanactaacgttacccaaactaatagtaaaactacttaagtcttaggtaccagacaaggacgaccaaggacacgcctccgtaggctgctactactttacgngggtacaacttcccgtaaccccggggtaagtccccggggtccccctaggacccgtaattccgaggttcggcaggggccgggttcgtagggggactagtgtttccacctctacgaccatcagcacgtctgcgagactagaagtagtggtcggtacttagtttattaattagtaactaaataattaattattatacgttcgtacggtacgttacgacgtaaacggacgtaggtacgtatacgngtaacgaacgtacgtagtcggtaccagaccg

SEQ ID NO: 430633 - DNA, 679 bp, Homo sapiens
  misc_feature: GZ8MTXP02G7BLE.19.71.G05.1.454.CMB.2.raw
  modified_base (245)..(245): a, c, t, g, unknown or other
  modified_base (256)..(256): a, c, t, g, unknown or other
  modified_base (321)..(321): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccacggggacatcgtgatcgacccagtctccagacctccctggctgtgtctcgtgggcgacggcggccaccagtcaactgacaagtccagccactaattctttanactataccaanaatacaaactctagcttagacagacagacgacagacacgcctcgaggctcgctactactttacgnggactacgtaccgtaacccggacgtccgggtcccctagaccgtatacgagggtcggacgtcggggtcgggtacgtacggggaactacgttactttaccgacttcctacctaaccgtatacgacgtccgacgtcccgtagacgtaacggtacgtaaggtaaacgtggttacggttacggttacgtttaagttttaacgtttaacgtttaacgttaacttaaacttaaatttaaatttaacgtttaacgtttacgttacggttacggttacgttacgtaacggtaacggtaaacgggtaacggtaacggtaacggtaacgtaacgtacgaacgtaacgtaacgtacggtacgtacgtacg

SEQ ID NO: 430634 - DNA, 564 bp, Homo sapiens
  misc_feature: GZ8MTXP02H7B9O.19.71.G05.1.454.CMB.2.raw
  modified_base (244)..(244): a, c, t, g, unknown or other
  modified_base (312)..(312): a, c, t, g, unknown or other
  modified_base (319)..(319): a, c, t, g, unknown or other
  modified_base (368)..(368): a, c, t, g, unknown or other
  modified_base (408)..(408): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccgatacaactgacaagtccagccacaattctttanacagttccaacaatgaaaactacttagcttggtaccagcaagagaccaggacagcctctaggctgctnatttacnggcatcctacccgggatcccggggtccctggacctatttcgagttggcngggtcgggtctgggggacaggtatttcacttcacacccancagcacgccgtgacgagcgtaagaatgtgtgtacttagtttattagttagtactaaataattaattattagttacgttacggtacggtacgtacgacggaaaggaccgtaagggtacgtactagaagaacgaacgacgtagtacgtacgtacgacg

SEQ ID NO: 430635 - DNA, 641 bp, Homo sapiens
  misc_feature: GZ8MTXP02H3V8Q.19.71.G05.1.454.CMB.2.raw
  modified_base (235)..(235): a, c, t, g, unknown or other
  modified_base (281)..(281): a, c, t, g, unknown or other
  modified_base (287)..(287): a, c, t, g, unknown or other
  modified_base (336)..(336): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcactgtcgccatcgtcgggacagagtcgntagcgacagtgttgcttggcacgtggtcaggcacgtcccatcgagngtcagngtggcgtaggagactatattcatcgacaacacgtagaactactaaattnagacacgtatcttggtagagtacgtacgacgtagaactaactacgaaacgtacgaacacgataaccgaaagtaacctacgtttaccctacgtcgacgacgtacctacgtaccttacgtaggttaccgaaccgttaccccggaagggtaaccggtaacggggttacgttaacgttacgtttaaaccggtcgggtaaacggggtaaaccggaaccggtacccccgaaagtaacggtaacctacgttacccgaacccgtaacccgttaccggttaccgtaccggttcggttacgttaaccgttaaggg

SEQ ID NO: 430636 - DNA, 509 bp, Homo sapiens
  misc_feature: GZ8MTXP02H7E7I.19.71.G05.1.454.CMB.2.raw
  modified_base (327)..(327): a, c, t, g, unknown or other
  modified_base (387)..(387): a, c, t, g, unknown or other
  modified_base (452)..(452): a, c, t, g, unknown or other
  modified_base (484)..(484): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacagtgttgcttggcacgtgggtcaggcacgtccccatcgagaggtctaggagtggctggggaaggcattatttcatgtaccaanacgtggaactacaaattatgcaccatctgttgagagtcgactgacaatcaacgtagacanatacgaaagaacctagttcctcctgacacgtctcgtacctctgtcaccgtcccgagcgacgggtntatattactgtaggacgacgccccatacgacntcgccactcgtctcgtggtcgctag

SEQ ID NO: 430637 - DNA, 515 bp, Homo sapiens
  misc_feature: GZ8MTXP02FH59G.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttctcctgcccgtgctgggcctcccacaaggtgtcctgtcacaagtacagctgcagcagtcaggtccaggactgatgaagccctcgcagaccctctcgctcacctgtgcccatcgtccggggacagagtcgctagcgacagtgttgcttggcacgtggtcaggcagtccccatcgagaggtcagagtggctagggaagacattatttcatgtaccaaacgacgtagaaatacaaattatgacaccatctgttgagagtcgactgacaatacaacgtagacacatacgaagaacctagtcctcctgcacgctcgacctcgtcgtacgaccgtaccggacggacgtacggtagtaactacgttacgtaggtaggaacgacggaccccaag

SEQ ID NO: 430638 - DNA, 541 bp, Homo sapiens
  misc_feature: GZ8MTXP02IDHCS.19.71.G05.1.454.CMB.2.raw
  modified_base (241)..(241): a, c, t, g, unknown or other
  modified_base (315)..(315): a, c, t, g, unknown or other
  modified_base (343)..(343): a, c, t, g, unknown or other
  modified_base (357)..(357): a, c, t, g, unknown or other
  modified_base (365)..(365): a, c, t, g, unknown or other
  modified_base (410)..(410): a, c, t, g, unknown or other
  modified_base (415)..(415): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtggggcgaggcgggccaccgatcgaactgacaagtccagccacaattcttttanacagttccaaacaatgaaaactacttagcttggtaccagcagagaccaggacagcctcaggctgctcatttacngggcatcgtaccgggatccgggtccccngaccattcagtgcnggcgggtntgggacagatttcactctcaccatcagcagcctgcaggctgaaancgtgnggctagtttattatgtacaatattattatttatacgttcgtaggtacgttcggaccgtaaaggggacctaagggtacggaattaagaacgaacggaaccgtaaacgtggttacggactcggaaccg

SEQ ID NO: 430639 - DNA, 541 bp, Homo sapiens
  misc_feature: GZ8MTXP02GKYCP.19.71.G05.1.454.CMB.2.raw
  modified_base (374)..(374): a, c, t, g, unknown or other
  modified_base (391)..(391): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtgggtcaggcacgtccccatcgagaggtctaggagtggcgtaggggaacggacattatttcatcgtaccacgacgtaggaaatacaaattangacactatctgttgagngtcactagacaatacaacgtagacacatacgaaagaacctagttacctcctagctacgctcgacctcgtcggtacgaccgtaccggacggacgtacggggttataagttagtaacgtaggtacggaacgaccggaccccaagtacgaacc

SEQ ID NO: 430640 - DNA, 584 bp, Homo sapiens
  misc_feature: GZ8MTXP02GPH4C.19.71.G05.1.454.CMB.2.raw
  modified_base (241)..(241): a, c, t, g, unknown or other
  modified_base (319)..(319): a, c, t, g, unknown or other
  modified_base (371)..(371): a, c, t, g, unknown or other
  modified_base (408)..(408): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccatcaactgcaagtccagccacaatcttttanacagttccaacaatagaaactacttagcttaggtaccagcagacgaccaggacacgcctcaggctgctctatttacgnggctatccgtacccggaatccggggtcccctagaccgtattccgagtggacncggcgggttctaggggacaggtatttcactctcaccntacagctcgcctgccagggctagaaagtgttaggtcggtacttaaggttttattagttacgtaacgtaaattaattatttaattaactacgtttacggtcggtacgtttcggaccgtaaagggacctaaggtacggtaatagtaacgacgaccgtaacttggacggttccacgacg

SEQ ID NO: 430641 - DNA, 573 bp, Homo sapiens
  misc_feature: GZ8MTXP02F8JD2.19.71.G05.1.454.CMB.2.raw
  modified_base (242)..(242): a, c, t, g, unknown or other
  modified_base (317)..(317): a, c, t, g, unknown or other
  modified_base (399)..(399): a, c, t, g, unknown or other
  modified_base (406)..(406): a, c, t, g, unknown or other
  modified_base (411)..(411): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccacgatacgaactgacaagtccagccacaattctttanacagttaccaacaatgaaaactacttagcttgtaccagcagagaccaggacagcctctaggctgctcatttacgnggcagtcgtaccgggatccggggtacccctagaccgtattcgagtcggcagggcgggtctggggactagtactttcacttcncacctanacacncacgcagacgagcgtagaagtgtgtagtattagtttatacttagtaactaaattaatttacttattacgtacgttacggtacggtaccgttacggaacgtaacgggtaacgtaggtacgtaacttacgtaacgtaacggacgtacgtgtacggactacgacc

SEQ ID NO: 430642 - DNA, 653 bp, Homo sapiens
  misc_feature: GZ8MTXP02IKE00.19.71.G05.1.454.CMB.2.raw
  modified_base (410)..(410): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccactccgtccggggacaggacgtcgcgtagcgacgtaggtgttgcgttggctacgtcgggtcaggccacgtccccagtaccggagtaggtctaggaggtgggcgtaggggaacggtactaagttactttacagttcgtaccaaacgtacgtaggtaaattaactaaaattntacgacactattacgtagttacgagtagtcgtactagaaactaacgtaacgaaaccgtacgaaacaacgtaacgtaacggaaacgtaaacccgttacttcccgtacccgtagacgtacggtaccttacgtaaccttcgttgtaccggtaccgtacccgggaaacgggtacgtacgggggtttattaacgttaacgttacgggtaggttacgggaaaccggacccggtaaccccaacgtaacgg

SEQ ID NO: 430643 - DNA, 725 bp, Homo sapiens
  misc_feature: GZ8MTXP02IJRNF.19.71.G05.1.454.CMB.2.raw
  modified_base (229)..(229): a, c, t, g, unknown or other
  modified_base (241)..(241): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccaggggacatcgtgatgacccagtctccagactccctggctgtgtctctgggcgaggcgggccacgatacgaactgacaagtccagccaanaattcttttaanacagttaccaaacaatagaaaacttactagcttaggaccagcaagacgaccaggtaccagtccctacgtaggctacgctactaagtttacgcgggtacacgttacccgtaaccccggggtaacgtccccggggttacccacggtaccccgtattcgaacgggtcggaccgtacgggtccggggtcgtaggggaaacctagttacctttcgaacctttccctacaacctaacgtacgacgcgacgtacgtaccgtacgacgtacgtagtaacgtacgttacggtacggtacgtttaagtttaagtttaacgttaacgttaacttaaacttaaatttaactttaacgtttaacgtttaacgttacggttacgggttaaccggttaaccggtaaaccggtaaacgggtaaacggtaaacggttaacggtaaacgttaacgtaacgtaacgtaacgtaacgtacggtacggtacgtacgtacgtaacg

SEQ ID NO: 430644 - DNA, 559 bp, Homo sapiens
  misc_feature: GZ8MTXP02JGFY9.19.71.G05.1.454.CMB.2.raw
  modified_base (226)..(226): a, c, t, g, unknown or other
  modified_base (236)..(236): a, c, t, g, unknown or other
  modified_base (247)..(247): a, c, t, g, unknown or other
  modified_base (313)..(313): a, c, t, g, unknown or other
  modified_base (368)..(368): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaanaattctttanacagttccaanaatagaaaactcttagcttaggtaccagcagagaccaggacagcctcctaggctgctctatttacngggcattccgtacccggggaatccggggtcctgaccgattcagtgcaggcgggtntggggacagtatttcgactctacacatcgagtcacgcctgacgacggctaggaaagtagttggtcggtacgtttaagtttatttagttacgtaactaaactaattattaattacttacgtcgtaggtaacgttcggacgaaacgggtacaaggtcgaatatacgaagacgtaacgtcgtgacctgactacg

SEQ ID NO: 430645 - DNA, 643 bp, Homo sapiens
  misc_feature: GZ8MTXP02JCCFC.19.71.G05.1.454.CMB.2.raw
  modified_base (309)..(309): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctctcgctcacctgtcgccatccgtccggggacaggagtcgctagcgacagtgttgcttggcacgtgggtcaggcacgtcccagtcgagnggtctagagtggcgtagggaacggactagttattcagtcgtaccacgtacgtaggtaaataactaaattacacgaccacctaagttcttaggttacgagtaacgttcgacgttacgaaactaacgttaccgaaaacggttaacgaactaaacgaacgtaaaccggaaaaccgtaaacccgtacggtttaccctacccgttaggacctaacggtccgttacgacccgttacgtcggtaccgtaacccgtacccgggaaaggtaaccggtacgggttagtaacgttaacgttaacgtgggtaacggaaaccgcccggtaacccctagtaacgaacg

SEQ ID NO: 430646 - DNA, 585 bp, Homo sapiens
  misc_feature: GZ8MTXP02JZSYQ.19.71.G05.1.454.CMB.2.raw
  modified_base (235)..(235): a, c, t, g, unknown or other
  modified_base (309)..(309): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactactagcttggtaccagcagagaccaggacagcctcctaggctgctcatttacngggctatcgtaaccccggggatcccgggggtccctcggacccgtattccagttcggacaggccggggtctggggaccagtactttcactctccgaccctatccagccagccctgccaggctagaagagtgtggctagtttattagttcgtacaactaaattattaattaattacgtttcgtaggtaccggttacggtacccgaaacggggtaacccgtaagggttacgaagttaactacgtaacgacgtaaccgtggtacggcgttcgactaaccg

SEQ ID NO: 430647 - DNA, 679 bp, Homo sapiens
  misc_feature: GZ8MTXP02HA3KR.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctctcgctcacctgtcgccatcgtccggggacagagtcgctagcgacagtgttgcgtttggctacgtgggtcaggccacgtccccagtccggagtacggtcgtaaggaggtgggtaccgttagggggaaaacggtacctaagtttacttttacaacgttacggttaccccgaaaacgtaccggttaggtaaaacttaacctaaaaagtttactacgacctaacctaacttcgtggttagacgtaggttcgaacgtagaactaagtacgaaacgtacgaactacgaacgtacgaaacgtaacctacgttacctacccgtacggacacgtcgtacgacccgttacgtcggtacgtaaccccgttaccgggaacggtacccggtaacggggttacttaaagttaacgttaaccgttacgggtacgggtaaacggaacccgggtacccccaaaggtaacccgg

SEQ ID NO: 430648 - DNA, 516 bp, Homo sapiens
  misc_feature: GZ8MTXP02HYY6L.19.71.G05.1.454.CMB.2.raw
  modified_base (203)..(203): a, c, t, g, unknown or other
  modified_base (222)..(222): a, c, t, g, unknown or other
  modified_base (344)..(344): a, c, t, g, unknown or other
  modified_base (365)..(365): a, c, t, g, unknown or other
  modified_base (407)..(407): a, c, t, g, unknown or other
  modified_base (430)..(430): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctcgcagacccctntcgctcacctgtgccatcgtccggggacagagtcgctagcgacagtgttgcttggcactgggtcaggcagtccccatcgagaggtctagagtggctggggaagacagtatttcattgtccanacgtaggaaatacaaaagttntgacacatctgttgagagttacgactgacaatacaaacgtanacaacatacgaagaacagttacnccctgcagtcagacctcgtcgtcgactcccgaggacacgggtagtactagttaacgtggtacggaacgacgacccctagtacgaac

SEQ ID NO: 430649 - DNA, 692 bp, Homo sapiens
  misc_feature: GZ8MTXP02HIPXP.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgcctcacctgtcgcctatccgtccggggacagacgtcgctacggcgacagttgtgcgttggcacggtgggtacaggccacgtccccagtcggagacggtctaggaggtggacgtaggggaaacgactaattacgtttcaagttcgtaccaaacgtacggtaggaaacttaaacctaaaatttactacggaaccctaacgtaattcgtaggttagaagtacgttacggaacttacgaaactaaactacgtaaaacgtacgaaacaacgtaacgttaaccgaaaacgtaaccgttaccgttcctaccccgagtaccgtacggtacctaccggaaccctttcggtacggttaccggaacccgttaccccgggaaagggtaacccgttaccgggggttaattaacgtttaaacgttacgggtacggttaacgggaaaccggaccccggtaacccctaagtaaacccgg

SEQ ID NO: 430650 - DNA, 702 bp, Homo sapiens
  misc_feature: GZ8MTXP02I67V9.19.71.G05.1.454.CMB.2.raw
  modified_base (238)..(238): a, c, t, g, unknown or other
  modified_base (251)..(251): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttaanactagttaccaanaatagtaaacttactagtcttacgaccagacagacgacgagacacgcctacgtagctcgctactactttacgtgggactacgtaccggtaaccgggtacgtcccgggtcctacggaccgtagttacgacggtcggacgacgggtccggggttacgtacggggaactagttactttccgacttcctaccaacctactaccgacgccgacgtcccgtacggaccgacggtctagtaacggtagttcgggtacggtacgtttaagttttaattacgtttacgtaaaccttaaacgtaatttaaattttaacgtttactttaccggtttacggttacggttaccggtttacggtaaacccggtaaacggggtaaaccgttaaacggggttacgtaaacgttaacgtacgaaacggtaaacgtaacggttcggtacggtaccgtacgaccgtaacg

SEQ ID NO: 430651 - DNA, 711 bp, Homo sapiens
  misc_feature: GZ8MTXP02HY9JP.19.71.G05.1.454.CMB.2.raw
  modified_base (244)..(244): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctcctggctgtgtctcgtgggcgagcgggccacgatacgaactgacaagtccagccactaattcttttaanactacttaccaaacaatagtaaaactacttagtcttaggtaccagacagacgaccgaggacacgcctacgtaggctgctactactttacgtggacacgtaccgtaacccgggtaacgtcccgggtacccctacgaccgtagttcgacggtcggacgcggggtccgggttacgtacggggaactagttactttaccaacccttcctaccaacctactaccgaacgaccacgtcccgtaggaccgtacgggacgtaggtaaacgtagttacggtacggtacgtttaagttttaacgtttaacgttacgtaacctaaaacttaaatttaaacttttaactttaaacgtttacgtttacgggttacgggttaccggtttaccggaaccggtaaaacggggtaaccgtaacgggtacggtaaacgttaacgtaaccgaacggtaacggtaacgtggtacggtcgtacgaccg

SEQ ID NO: 430652 - DNA, 528 bp, Homo sapiens
  misc_feature: GZ8MTXP02H7INK.19.71.G05.1.454.CMB.2.raw
  modified_base (236)..(236): a, c, t, g, unknown or other
  modified_base (315)..(315): a, c, t, g, unknown or other
  modified_base (367)..(367): a, c, t, g, unknown or other
  modified_base (382)..(382): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccacatctttanacagttaccaaacaatagaaaactacttagcttaggtaccagcagagaccaggacagcctcctaggctgctcatttacnggcactccgtacccgggatcccggggtcccctagaccgtattcgagtcggcnggcgggtctgggacngtattcactctacaccatcagcagcctgcagctagaagatgtggtactagtttataattgtaacaatataattattatactcgtgtacgtcgacgtaaagggacctaagggtgaattacgaacgagtacgaacgtgtcgactcgac

SEQ ID NO: 430653 - DNA, 686 bp, Homo sapiens
  misc_feature: GZ8MTXP02GTRVA.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgcctcacctgtcgccatccgtccggggacaggacgtcgctagcgacagtgtgcttggcacgtgggtcaggcacgtccccatcgagaggtcagagtggacgtggggaagactattattacattcgtccaaactacggtagaaataactaaattatacgacaacctattcgtagttagaagtagtacgtactagaaactaaacgtacgtaaaaccggtaacgaaaccaacgtaaacgttaaccggaaaacgtaaaaccccgtaccgtttaccccgttacccgttacggaacctacggtaccttaccgggtaaccccttacgttccggtttaaaccgacccgtttaccccgggaaacgggttaacccggtacggggttaacgttaaaccgttaagtttaacccggttaggggttaaacgggtaaaaccggtaccccggaaccccccgtaaaaggtaaacccg

SEQ ID NO: 430654 - DNA, 573 bp, Homo sapiens
  misc_feature: GZ8MTXP02GR4IP.19.71.G05.1.454.CMB.2.raw
  modified_base (370)..(370): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtggtcaggcagtccccagtcgagaggtctagagtggctggggaaggactattattcagttgtccaaacacggtaggaatacgaaatttntagaccactatctgttacgagtacgtacgtactagaacaatacgaaacgttacgaacaacgtaatacggaaacgtaaccgtaacgttcctcccgtagactacgtctacgtacctacgtcgtagacccgttaccggacggtaccgtacgggtagtaacgttaacgttacgtaggtacggaacgaccggacccccgtagtaaccg

SEQ ID NO: 430655 - DNA, 538 bp, Homo sapiens
  misc_feature: GZ8MTXP02JY67X.19.71.G05.1.454.CMB.2.raw
  modified_base (236)..(236): a, c, t, g, unknown or other
  modified_base (302)..(302): a, c, t, g, unknown or other
  modified_base (309)..(309): a, c, t, g, unknown or other
  modified_base (364)..(364): a, c, t, g, unknown or other
  modified_base (429)..(429): a, c, t, g, unknown or other
  modified_base (433)..(433): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaacaatagaaactactagcttggaccagcagagaccaggacagcctcctaggctgctnatttacngggcagtacctacccggggaatcccggggtcccctagaccgtattcgaggtggcnggccgggtctaggggacaggtactttccactctcaaccatcagcagcccagccaggctagaaagntggnggatagtttattatgtactaataattattattatacgttcgtaggtacgttcggaccgaaagggtaccaaggtcgaatagtcaaggacctagtgcggactagacc

SEQ ID NO: 430656 - DNA, 588 bp, Homo sapiens
  misc_feature: GZ8MTXP02JASZK.19.71.G05.1.454.CMB.2.raw
  modified_base (244)..(244): a, c, t, g, unknown or other
  modified_base (309)..(309): a, c, t, g, unknown or other
  modified_base (379)..(379): a, c, t, g, unknown or other
  modified_base (438)..(438): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccgatcaacgtgacaagtccagccacaatctttanacagttccaacatagaaaactcttagcttggaccagcagagaccaggacagcctcaggcctgctnatttacaggcactccgtaaccgggatccccggggtccctagaccgtattcgagtggcgagggccgggttnaggggactagtctttcacgttcacaccatacgagtctacgcctgaccgagctaagagtntcggtagcttagtttatgttacgtacaaattaaattctttaattacgtacctttaggtacggtacgttaccggaaaccgtaaagggtaaccgtaaaggggttacgtaacgtaacgtacggaacgttaacgtacgtggtaccgtacgtacg

SEQ ID NO: 430657 - DNA, 884 bp, Homo sapiens
  misc_feature: GZ8MTXP02I4DU8.19.71.G05.1.454.CMB.2.raw
  modified_base (240)..(240): a, c, t, g, unknown or other
  modified_base (321)..(321): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgagcgggccaccatcaactgcaagtccagccaactattctttanacagttaccaacaatagaaaactactagcttaggtaccagacaagagaccaggacacgcctcaggctgctactatttacgnggacacgtccgtacccggggaagttccccggggtcccctacggaccgtacgttaccgaggttacggacgacggggtccggggttcgtacgggggtaacccaagggttaaccgttttacccaaaccgtttccctaaccgtaaccccgtaattaccccgaaagggtcccaaaccgggtcccccttaagggaccccgtaaacgggggacccttaaacggggaaaaacgggttaacgtttggggtttaaaccgggggttaacccgttttaaaacggtttttttaaacggtttttaagggtttaccgttaaaacccgtttaaaaaaccgtttaaaagtttttaaacgttttttaaacgtttaaatttttaaaaccccgggttttggggttttaaaacccggggttaaacccgggtttttaccgggggaaaacccccgttaaaagggggtaaaccccgtaaaagggggttaaacggtaatttaaacggttaacgaaaaccgggggttaaaacggttaaaacccgggtttacgggttagggggtaccctttaacgggggtaaaacccccg

SEQ ID NO: 430658 - DNA, 547 bp, Homo sapiens
  misc_feature: GZ8MTXP02H803F.19.71.G05.1.454.CMB.2.raw
  modified_base (458)..(458): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctgcagaccctctcgctcacctgtgccatccgtccggggacagagtcgctagcgacagtgttgcttggcacgtgggtcaggcacgtccccatcggagaggtctaggagtggcgtaggggaaggactatatttcagttcgtaccaaacgtacgtaggaaattaactaaaattataaccaaccctatctgttagagagtacgactagaacaatacaaacgtaagacaaccagtacgaaagaaccagttccncctagcagctcgacctagtcgtacgacctacccgaggacgacgggtagtactagttaacgtgtacggacgaccggaccccagtacgacc

SEQ ID NO: 430659 - DNA, 627 bp, Homo sapiens
  misc_feature: GZ8MTXP02HWA67.19.71.G05.1.454.CMB.2.raw
  modified_base (428)..(428): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctccgctcacctgtgcccatccgtccggggacaggacgtcgctagcgacaggtgttgcgttggcacgtgggtcaggccacgtccccatcgagaggtctaggagtggcgtaggggaaacgactattacgtttcagttcgtccaaatacggtaggaaattaacaaattatagacacattctagtagagagtacgactagaacaanacgaaacgtagaacaactaagtaaccgaaacgtaaacccgtacgtttacccaccccgttgaccgtaagtccgttacgaaccccgttcgttacggtacgtaacccgttacccgggtaaacgggaccgtaacgggggtttataacgttaacgtttaacgtagggttacgggaaaccgacccgggaccccctaaagtaacgg

SEQ ID NO: 430660 - DNA, 518 bp, Homo sapiens
  misc_feature: GZ8MTXP02FZKGH.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagtgttgcttggcacgtgggtcaggcacgtccccagtcgagagtctagagtggcgtggggaacgactatattcatcgtaccagacgtagaaatacaaattatgacaaccatctagttgagtagtacgactagaacaatacaagtagacacatacgaacaacctagttcctcctagacagctacgacctctacgtcgactcccgaaggacgacgggttatatagtaacgtggtacggaacgacgacccatacgaac

SEQ ID NO: 430661 - DNA, 540 bp, Homo sapiens
  misc_feature: GZ8MTXP02I8YED.19.71.G05.1.454.CMB.2.raw
  modified_base (224)..(224): a, c, t, g, unknown or other
  modified_base (230)..(230): a, c, t, g, unknown or other
  modified_base (236)..(236): a, c, t, g, unknown or other
  modified_base (246)..(246): a, c, t, g, unknown or other
  modified_base (264)..(264): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagccancacatnttatanatacacatanaactactatctcgtacanacagagacagacacgactcgtacgctgtctactacttacgtacggactactaccgtaccggtaacggtaccggtaccccgtacgaccgtactacgacgtacggacgcggtcggtcgtacggacgtagtacgttactactactactacactacgacgacgacgactacgacgacgacgtagaagtagtagtagtagttagttattagttacgtactaactaattaattaattaacgttacgttacgttacggttacgtacggtacgtaaacggtaac

SEQ ID NO: 430662 - DNA, 542 bp, Homo sapiens
  misc_feature: GZ8MTXP02ICDD6.19.71.G05.1.454.CMB.2.raw
  modified_base (228)..(228): a, c, t, g, unknown or other
  modified_base (290)..(290): a, c, t, g, unknown or other
  modified_base (414)..(414): a, c, t, g, unknown or other
  modified_base (472)..(472): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccgggganagagtcgctagcgacagttgtgcttggcacgtgggtcaggcagtccccatcgagagtctagngtggctaggggagacattatttcatgtaccaacacggtaggaaactacaaaattacgtgactaacccattccttgtttaggacgagtacgactagacaattcgaaacgtagacacatacgaaanacctagtacctccctgacacgctcgtacctgtgtcacctcccggaaggacgtacggtntagtatactggtacggagaccgaccccgatacgacactcgccctacgtcgtctcgtaggtctacttaagg

SEQ ID NO: 430663 - DNA, 665 bp, Homo sapiens
  misc_feature: GZ8MTXP02J14U8.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagaaaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtgggtcaggcagtccccagtcgagaggtctagagtggcgtaggggaacggactattactttcatcgtaccacgacggtaggaaactacaaaattactacgaccaaccctaagttcttggttaggaaggtacgttacggaaccttgaaactaaacgtaccgtaaacggttaacggaaccaacctaagtaccggaaaacgtaaacccgttaacggtttccctacccccgttaggaccaacggtcccttacggtaaccccttcgtttacggtaccgacccgtacccccgggtaaagggaaccgtaacgggggtactttaaacgttaacgtttaaccgtgggtaacgggaaacggtacccgggaccccctaagttaaccgaaccg

SEQ ID NO: 430664 - DNA, 652 bp, Homo sapiens
  misc_feature: GZ8MTXP02HH8YK.19.71.G05.1.454.CMB.2.raw
  modified_base (244)..(244): a, c, t, g, unknown or other
  modified_base (338)..(338): a, c, t, g, unknown or other
  modified_base (398)..(398): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacgaactgacaagtccagccacaattctttaanactagtaccaacaatacgaaactactagcttaggaccagacgaagacgaccgaaggaccacgtccctacgaggcctagccttactaatttacgngggactacgtacccggtaacccggggtacgttccccggggtaccccctacggtaaccgtnttacgaggtcggacgacggggtccgggtcgtacgggactagttactttccacctcctaccacctatcgacgcgacgtcctagacgacggctaaggaagtagtggtacgtattagtttatagttacgtaactaaattaatttaatttaagttacgttacgttacggttacggtaccggttaccggaaccgtaaacgggtaacgtaagggtacgtaacgtactaacgtaacgaacgtacgtggtcggtactacgac

SEQ ID NO: 430665 - DNA, 597 bp, Homo sapiens
  misc_feature: GZ8MTXP02GJPEH.19.71.G05.1.454.CMB.2.raw
  modified_base (231)..(231): a, c, t, g, unknown or other
  modified_base (239)..(239): a, c, t, g, unknown or other
  modified_base (419)..(419): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccanatctttanacagttccaacaatgaaaactacttagcttggtaccagcagagaccgaggacacgcctacctaggctgcctactatttacgtggctacgtccgtacccgggtaagtcccggggtccccctagaccgtattcaggtcggctcgggcgggtacgtgggactgtactttcactctacacctanacgagcacgtcctgacgagtcgtagaagtgtagtcgtattagttacttagtacgtaactaattaattattattacgtacgttacggtacggtacggttacggaaccgtaaacggtacgtaacgggtacgtaacgttacgaacgtaacggtaacgtacgttcggtacgtacgtacgacg

SEQ ID NO: 430666 - DNA, 523 bp, Homo sapiens
  misc_feature: GZ8MTXP02GJ0S6.19.71.G05.1.454.CMB.2.raw
  modified_base (313)..(313): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgtgcttggcacgtggtcaggcacgtccccatcgagagtctagngtggctagggagacatatttcatgccaacacgtaggaatacaaattatacgacacatctgtagagtacgtcactagacaatacaaagtagacacagtacgaacgaactacgttcctccgtagacagactacgtacctacgtgtacgaccgtaccgacggacgacggtagtactaagtacgtagtacggaacgtaccggaccctagtaacg

SEQ ID NO: 430667 - DNA, 547 bp, Homo sapiens
  misc_feature: GZ8MTXP02JRU2I.19.71.G05.1.454.CMB.2.raw
  modified_base (238)..(238): a, c, t, g, unknown or other
  modified_base (315)..(315): a, c, t, g, unknown or other
  modified_base (440)..(440): a, c, t, g, unknown or other
  modified_base (443)..(443): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcagagaccaggacagcctctaggctgctcatttacgngggcactccgtaacccggggaattccggggtaccccctggacccgtattcgaggtcggcagggtccgggtcgtaggggacctagtactttccactctcaccatcagcagcctgcaggctagaagntgnggtactagtttattatgtacaaactaattattattatacgttcgtaggtacgttcggacgaaggactaaggtcgtatatgaacgacgtaacgtgacggctgacc

SEQ ID NO: 430668 - DNA, 623 bp, Homo sapiens
  misc_feature: GZ8MTXP02GOHQF.19.71.G05.1.454.CMB.2.raw
  modified_base (235)..(235): a, c, t, g, unknown or other
  modified_base (279)..(279): a, c, t, g, unknown or other
  modified_base (311)..(311): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatctttanacagttccaaacaatagaaaactctagcttaggtaccagcaganaccagacagcctcctaggctgctcatttacgnggctacgtccgtaccggagtcccgggtcctcgaccgtatcgaggtcggacgacggtcgggtcgtagggactagtacttcacttctaccacctatacacgacacgtccgacgacgacggcgtagaagtagtaggtacggtactttaagtttaacgttacgttacgtaaactaaacttaaatttaatttaacttaacgttaccgttacggtacggtaaccggttaccggaaaccggtaaacgggaaccggtaaacggtacgtaaactacgtacgaaacggtaacgtaacgtacggtacgtactacgacgtaacc

SEQ ID NO: 430669 - DNA, 709 bp, Homo sapiens
  misc_feature: GZ8MTXP02I0KJM.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctctacctcgtcgcactacgtccggggaccgagagtcgcgtacgtcgacgacgtggttcgtcgtcggtcgacgtacgggtcggtacggacgacgtaccccgtaccgtacggtacggacggtacggtagtaggtagggtccggtaggggtaacgggacgtaagttatttacgtacacgttaccgaaccgtaacggtaacggtaaacgtaaactaaactttaaagttcgaaccacccgttatacttggtttaggaagacgggttacccgaattacaaacgaactacggtaaaccgtacggaacaacccgttagaaccgttaaacgggaaaaccctcgtttcccgttacccctggaacgaccgttacgtaccaacccggtttcctacggtacgtaaccccggacccgacggggtacgtaaaccgggtttgtaaataacgtttaacggttcggaacgggaacgttacccgacccccgtataaaagg

SEQ ID NO: 430670 - DNA, 522 bp, Homo sapiens
  misc_feature: GZ8MTXP02G1DTY.19.71.G05.1.454.CMB.2.raw
  modified_base (412)..(412): a, c, t, g, unknown or other
  modified_base (453)..(453): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcactgggtcaggcagtccccatcgagaggtctagagtggctggggaaggacagtatttcatcgtccaaacacgtaggaaatacaaaattatagacacctatctagtgagagtcgactagacaatacaaacggtanaacacaatacgaaacgaacctacgtcctacctagacagctnacctctgtcgactccgacggacgacggtatataacgttacgtacggtagaacgaccggaccccataacg

SEQ ID NO: 430671 - DNA, 511 bp, Homo sapiens
  misc_feature: GZ8MTXP02F7CTZ.19.71.G05.1.454.CMB.2.raw
  modified_base (319)..(319): a, c, t, g, unknown or other
  modified_base (423)..(423): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagaggtcagagtggctgggaagcatatttcatgtccaanacgtgaatacaaattatgacaccatctgttgagagtcgactgacaatcaaacgtagaacacatacgaaagtaaccagttcacccctgacagctcgacctctgtnacctccggaggacgacggtgtaagtatacgtgtacggaagacggaccccaagtacgacatcgccacctcgtctcgtggttcgacttag

SEQ ID NO: 430672 - DNA, 575 bp, Homo sapiens
  misc_feature: GZ8MTXP02GQSMQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctgcagaccctctcgctcacctgtgccatcgtccggggacagagtcgctagcgacagtgtgcttggcacgtgggtcaggcagtccccatcgagaggtctagagtggcgtaggggaagactagtatttcattgtccaaacgacgtaggaaataacaaagttatgacactaatcttagtagaagtagtacgaactgaacaatacgaaacgtacgaacactaagtacgaaacgaaaccacgttactcccgtagacacgtactacgtacctcgtcgtacgaacccgttcccggaacggtaccgtaccggggtattaagttaacgtttaacgtaggtacgggaaacgtaccggaccccctaagtaaacg

SEQ ID NO: 430673 - DNA, 617 bp, Homo sapiens
  misc_feature: GZ8MTXP02GYXXO.19.71.G05.1.454.CMB.2.raw
  modified_base (241)..(241): a, c, t, g, unknown or other
  modified_base (252)..(252): a, c, t, g, unknown or other
  modified_base (266)..(266): a, c, t, g, unknown or other
  modified_base (314)..(314): a, c, t, g, unknown or other
  modified_base (450)..(450): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgaccccagtctccagactccctggctgtgtctcgtgggcgaggccgggccaccatcaactgcaagtccagccataattctttanacagttccaanaatagaaactctancttgaaccagcagagacaggacagcctcgaggctgcctctatttacgngggactacgtccgtaacccgggacgttccccggggtccctcggaaccctattccgaaggttcggaccgaaggggtccggggtcgtagggggaacctaggttactttccacttcctacacctatacacgcacgtccncgaccagtcgagaagtgttggaggtacttagtttattattagtaactaaataattattattatttacgtgttacggtacgttacgggaactaaacggggtacctaaaggggtacgtaactagttaccgaaaggacgtaaacgtggtacggaccgttagacctaaccg

SEQ ID NO: 430674 - DNA, 713 bp, Homo sapiens
  misc_feature: GZ8MTXP02HRLXU.19.71.G05.1.454.CMB.2.raw
  modified_base (292)..(292): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcagtccccagtcgagaggtctaggngtggcgtaggggaagctagttattttcgattcgtaccaaacgtacggtaggtaaacttaacaaaattttagacgtacaccctaattccgttagtttaggaacgtacgggtaccgtacttagaaacctaagttaccgaaaaccggttacgaaccgaaactaacgttaaccggaaaacggtaaaccctacggtttaccctacccgtagaccctaaggtcctacgttaacccttccgtacggtaccgtaacccgtaccccgggtaagggtacccgtacggggttactacgtttaaacgttacggttacgggttaaagggtaaaccggacccggtacccccgtaaagtaccggtaacctaacgttccgaaccccgttaacccgttccggttacccttcggttacggggttctaccgttttaacgg

SEQ ID NO: 430675 - DNA, 777 bp, Homo sapiens
  misc_feature: GZ8MTXP02IHZBT.19.71.G05.1.454.CMB.2.raw
  modified_base (244)..(244): a, c, t, g, unknown or other
  modified_base (324)..(324): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccgatcaactgacaagtccagccaactaatctttanacagttccaaacaatagaaactactagcttaggtaccagcagacgaccaggacagcctccgtaggctgctacatttacgnggactagtaccgtaaccccggggaactcccggggtccccctaggtaaccccgtatttccgaaggtcgggaccgtacggggtccggggtttacgacgggggaaacctaaggttacttttaccgacctacccttaccaaaccctactaccgaaggtacccgaacggtcccctaggaccgtaagggtccgtaaaggaaaggtaacgtttgggtacgggttacctttaaagggtttttaacttaaggtttacggtaaaccgttaaaacgttaaaagtttacttttaaaacttttaagtttaaccgtttaccgggtttacgggtaaaacccgggttttaccgggaaacccggttaaaacgggggtaaacccgttaaaacgggggttacggtaaactttagaacggttaacggaaaacccggtaacggttaggtacggtccgtttaacggtaacccccg

SEQ ID NO: 430676 - DNA, 550 bp, Homo sapiens
  misc_feature: GZ8MTXP02I4J7U.19.71.G05.1.454.CMB.2.raw
  modified_base (391)..(391): a, c, t, g, unknown or other
  modified_base (396)..(396): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtcagagtggctgggaagacattatttcatcgtaccaactacgtaggaactaactaaattatagtaaccattctgttagagtagtacgatagaacaatacaagtanaacanactacgaaacacctaagttcctacctgcacgctacgacctctgtcgacctcccgaggtacgtacggtataacttattacgtgtacggtaagaccggtaccccaagtaacgactactcgacctaaccgtcgtcctcgtggtctacttacgtacgg

SEQ ID NO: 430677 - DNA, 703 bp, Homo sapiens
  misc_feature: GZ8MTXP02G7EWI.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgttgcgttggcacgtgggtcaggccacgtccccagtcgaggtaggtctaggaggtggcgtaggggaaggactattatttcaagttcgtacccaaacgtaacggtaggtaaaacttaacctaaaatttatacggacctaaccctaagttcgttaggtttacggaaggtaacgttacccggaacttacgggtaaaaccaaaacgttaccgaaaaaccggttacggaaaaccaactaaacgttaacccggaaaacggtaaacccttaacggtttaccctacccccgttaggacccacggtacccgtacgtaaccccttcgttacggtaccgtaaaccccggttacccgggaaacgggtacccgtaacgggggttattaaacgttaacgtttacgtagggtacgggaaaccgtaccgggaccccctaaagtaaccg

SEQ ID NO: 430678 - DNA, 571 bp, Homo sapiens
  misc_feature: GZ8MTXP02FNH37.19.71.G05.1.454.CMB.2.raw
  modified_base (319)..(319): a, c, t, g, unknown or other
  modified_base (366)..(366): a, c, t, g, unknown or other
  modified_base (425)..(425): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccgatacgaactgacaagtccagccacaattctttatacagttaccaaacaatagaaaactacttagcttaggtaccagcagagaccaggacagcctcctaggctgctctatttacngggcatccgacccggggatcccggggtcccctgaccgattcagtgcnggcgggtctgggacagtactttcactctcaccatcagcagccctgcaggctagaaagtntgtggattagtttattattacgtactaaataattattattagtacgttcggtacggtaccgttacggacccgtaaaaggggaccctaaggggttacgaattaagtaaccgaaggaaccgtaaacgttgggtacggtacgtacgacg

SEQ ID NO: 430679 - DNA, 520 bp, Homo sapiens
  misc_feature: GZ8MTXP02FVN7A.19.71.G05.1.454.CMB.2.raw
  modified_base (344)..(344): a, c, t, g, unknown or other
  modified_base (361)..(361): a, c, t, g, unknown or other
  modified_base (480)..(480): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggctgggaagacatattcatgtccaanacgtgaatacaaatttngacaccatctgttgagtagcgactagaacaatcaaacgtagacacatacgaaagaacctacgttcctaccctgaccagcctagacctctcgtcgacctcccggaaggaccgacggggtntaagtaagttacgtagtaggaacgacggaccccagtaacg

SEQ ID NO: 430680 - DNA, 606 bp, Homo sapiens
  misc_feature: GZ8MTXP02GDDPH.19.71.G05.1.454.CMB.2.raw
  modified_base (371)..(371): a, c, t, g, unknown or other
  modified_base (380)..(380): a, c, t, g, unknown or other
  modified_base (442)..(442): a, c, t, g, unknown or other
  modified_base (568)..(568): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttaacagttccaaacaatgaaaactcttagcttaggaccagcagagaccaggacacgcctctaggctgctctatttacgtggactagtccgtacccgggaatccggggtccccctaggacccgtattcgagtcggcnggcgggtcnggggactgtagtttaccacgtctacacctatcagtcaagtcctagcgaggactaggaaagtntggtcggtacttagttttacgttaagttcgtaaccaaaacgttaattaacttattaacttaacgttcgggtacggtaacccgtttacgggaccctaaaaggggtaccctaaagggtcggaacttanaacgtaacgaacgtaacgtggtacgacttacggaaccc

SEQ ID NO: 430681 - DNA, 644 bp, Homo sapiens
  misc_feature: GZ8MTXP02IDTB5.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcagaccctctcgctcacctgtgccatccgtccggggacagagtcgctagcgacagtgttgcttggcacgtggtcaggcacgtccccagtcgagaggtctaggagtggcgtagggaagacattatttcatgtaccaagtacgtaggaactaactaaattactacgaccaacctattcgtaggttagagtagtccgactagaactaaacgtcaaacgtacgaacaactaacgtacgaaaacgtaacctacggtttaccctaccccgtagtaccgaaggtccctacggtaaccccttcgttacgtaccgacccgttacccggaagggtaccgtaaccgggggttataatttaacgttaccgtaggtaacgggaaaccggaccggtacccccaaagtaccgaactacgtaccgaaccctaccgtcgttaccgtccgttaggtcgtacgtttaacgg

SEQ ID NO: 430682 - DNA, 508 bp, Homo sapiens
  misc_feature: GZ8MTXP02GPGUC.19.71.G05.1.454.CMB.2.raw
  modified_base (228)..(228): a, c, t, g, unknown or other
  modified_base (239)..(239): a, c, t, g, unknown or other
  modified_base (248)..(248): a, c, t, g, unknown or other
  modified_base (253)..(253): a, c, t, g, unknown or other
  modified_base (263)..(263): a, c, t, g, unknown or other
  modified_base (270)..(270): a, c, t, g, unknown or other
  modified_base (272)..(272): a, c, t, g, unknown or other
  modified_base (274)..(274): a, c, t, g, unknown or other
  modified_base (276)..(276): a, c, t, g, unknown or other
  modified_base (282)..(282): a, c, t, g, unknown or other
  modified_base (284)..(284): a, c, t, g, unknown or other
  modified_base (290)..(292): a, c, t, g, unknown or other
  modified_base (303)..(303): a, c, t, g, unknown or other
  modified_base (340)..(340): a, c, t, g, unknown or other
  modified_base (342)..(343): a, c, t, g, unknown or other
  modified_base (357)..(357): a, c, t, g, unknown or other
  modified_base (374)..(374): a, c, t, g, unknown or other
  modified_base (379)..(379): a, c, t, g, unknown or other
  modified_base (381)..(381): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttaanacatacaanaatanaaactactantgtacananananacagananctcagnnntctattagtgnatacgtaccggacgtccggtccccgtcgacgatcagngnngcggtcgtggaganatcactctcacatacanacacncngcgagagagaagatgtgatattattattatacaaataaataattaattaatacttacgtacgtacgtacggacgaacggaacgaacgtagtaagtataagaagaacgaacgtagtacgtcgtacgac

SEQ ID NO: 430683 - DNA, 726 bp, Homo sapiens
  misc_feature: GZ8MTXP02FNLUW.19.71.G05.1.454.CMB.2.raw
  modified_base (206)..(206): a, c, t, g, unknown or other
  modified_base (213)..(213): a, c, t, g, unknown or other
  modified_base (220)..(220): a, c, t, g, unknown or other
  modified_base (285)..(285): a, c, t, g, unknown or other
  modified_base (303)..(303): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggcacanacactancagtacncgacacaatactttattacacgtacaaccaatagtaaactaacttacgtacgttcgtacgaacanagagaccgacgacgaacnccgtccctacggtactcgactctactttacgttcggcgtactacgtacccggaaacggttccgggtccccccgtacgtaccgacgttaccgtcgtacgggacgacggtcgggtccggttgggtaacgaacgttaactttccgtaacctcttacctaaacccccaatttagacccgtaaggaccccaccgtaccgtacgacgtacgtacgtaaacggtaagtacggttacggtacggttaacgtttaaacgtttaagtttaacgttaacgttaaacttaaaactttaaactttaaactttaacgtttaacgtttaacgttacggttacggttaccggttaccggtaaaccgggtaaacggtaacggtaacggtaacgtaacgtaacgtaacgtaacgtaaacgtacgtacggtacgtacgtacg

SEQ ID NO: 430684 - DNA, 532 bp, Homo sapiens
  misc_feature: GZ8MTXP02GEJD4.19.71.G05.1.454.CMB.2.raw
  modified_base (238)..(238): a, c, t, g, unknown or other
  modified_base (365)..(365): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttaggtaccagcagagaccagacagcctctaggctgctcatttactgggctatccgtacccggggaatcccggggtccccctgaccgtattcagtggcngcgggtctgggacagatttcactctcaccatcagcagcctgccaggctagaagatggtggactagtttattattagtacaaataattattattattacttcgtaggtacgttcggacgaaagggactaagggtgaatagtaacgagacgtaacgtgtcggactgacc

SEQ ID NO: 430685 - DNA, 557 bp, Homo sapiens
  misc_feature: GZ8MTXP02G1FJ4.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctaggagtggcgtaggggaaggacattatttcatcgtaccaaacgacggtaggaaactacgaaaattatgacaccatctgttagagagtacgactgaacaatacaaacgtagacacatacgaacaactacgttcctcctgacagctacgacctcgtgtacgaccgtaccggaggtacgtacgggtatattacgttacgtggtaggaacggaccgaccccgagtaccgacacgtcgaaccgtaccgtcgtctccgtgtacgtacttaacgg

SEQ ID NO: 430686 - DNA, 533 bp, Homo sapiens
  misc_feature: GZ8MTXP02G3RBE.19.71.G05.1.454.CMB.2.raw
  modified_base (393)..(393): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcctgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccatcgagaggtctagagtggctgggaaggacatatttcatgtaccaacgacgtaggaaatacaaattatacgacaaccatctagttgagagtcgactgaacaatacaacgtagacaanatacgaaacgaaccagttacctccctagccagctgacctcgtagtcgactcccgagtacgacgggtatacgtattacgtaggtaggaaacgaccggacccctagtacgacactcgaccctactcgtctcgtcgtcgtacg

SEQ ID NO: 430687 - DNA, 557 bp, Homo sapiens
  misc_feature: GZ8MTXP02JT403.19.71.G05.1.454.CMB.2.raw
  modified_base (238)..(238): a, c, t, g, unknown or other
  modified_base (312)..(312): a, c, t, g, unknown or other
  modified_base (366)..(366): a, c, t, g, unknown or other
  modified_base (383)..(383): a, c, t, g, unknown or other
  modified_base (401)..(401): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactcttagcttgtaccagcagagaccaggacagcctctaggctgctgatttacngggctatccgtaacccgggatccggggtccccctagaccgtattccaggtggcngggccgggtctgggacngtatttcgactctcaccntcagctaacgcgcacggctagaagagtggtgctagtttattattagtacaaataattattattatacgtttacgtggtacgtttacggaccgtaaacgggaccgtaaggtacggtactatacgaaggaccgtaacgtggtcggtactcgacaaccg

SEQ ID NO: 430688 - DNA, 612 bp, Homo sapiens
  misc_feature: GZ8MTXP02H1AKO.19.71.G05.1.454.CMB.2.raw
  modified_base (246)..(246): a, c, t, g, unknown or other
  modified_base (258)..(258): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccgatacgaacgtgacaagtccagccacaattcttttanacagttaccaanaatacgaaactactagtcttacgaccagacagacgaccagacacgcctcgtagctgctactatttacgtggactagtaccgtaccggacgtccgggtacccagaccgtatcgaggtcggacgcgggtcgggttacgacgggactagtacttcacctctacactactcgacgcacgtcgagacgacgtcgtagaagtagtagtgtacgttagtttagttattagtaactaaactaaattaatttaattaacttacgttacggttacggttacggttaccggtaccggtaacggaacggtaacggtacggtaagtaagtaacgtaacgtaacgtacgtagtacgtacgtacgtacg

SEQ ID NO: 430689 - DNA, 690 bp, Homo sapiens
  misc_feature: GZ8MTXP02JPBKY.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaagccctcgcacgaccctctcgctcacctgtcgccatcgtccggggacagagtcgctagcgacagtgttgcttggcacgtgggtcaggcacgtccccagtcgagaggtctaggagtggctaggggaacgactatatttacgatcgtaccacgacgtaggaaattaacaaaatttagtacgacctaacccgtatttccgttagtttacggaaggttagtaccgaacgttaggaaacctaaacgtaccgtaaaacggttaacgaaccaaacgtaacgttaaccggaaaacgtaaaccccgtagtttaccccctacccgtacgaccaacgggtcttaccggtaccttcggttacgtacggtaaccctacccggggaacgggtaacccggttaccgggggttactttaaacgtttaacggttaaccggttagggttaaacggggaaaccgggttacccgggaccccccttaaaagggttaccgaaacccg

SEQ ID NO: 430690 - DNA, 627 bp, Homo sapiens
  misc_feature: GZ8MTXP02JIDB7.19.71.G05.1.454.CMB.2.raw
  modified_base (236)..(236): a, c, t, g, unknown or other
  modified_base (243)..(243): a, c, t, g, unknown or other
  modified_base (245)..(245): a, c, t, g, unknown or other
  modified_base (247)..(247): a, c, t, g, unknown or other
  modified_base (252)..(252): a, c, t, g, unknown or other
  modified_base (299)..(299): a, c, t, g, unknown or other
  modified_base (360)..(360): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtcagccacatctttanacatcanananaactntagctgacagacagacgacagacacgcctcagctgctactatttcgnggactacgtaccgtaccggtacgtccggggtcccctacggaccgtattcgacggtcggcgnggggtcggggtacgtacggggactagttactttaccaccttccctaccaaccctacgtacgtacgaccgacgccgtcgacgacggtacgtacgtaagtagtaggtacggtacgttagtttagtttagttacgttacgtaactaattaattaattaagtttacgttacggttacggtacggttacggtaccggtaaacgggtaacggtaacggtacggtacgtacgtaacgtaacgtaacgtaacgtacggtacggtacgtacgtacg

SEQ ID NO: 430691 - DNA, 637 bp, Homo sapiens
  misc_feature: GZ8MTXP02JIEH3.19.71.G05.1.454.CMB.2.raw
  modified_base (239)..(239): a, c, t, g, unknown or other
  modified_base (328)..(328): a, c, t, g, unknown or other
tcagtactctcgtgcacgaccggtgctcgatttagtgtcgtcgcaagagagagggggggtacaacaggcaggcagtggcagcaagatggtgttgcagacccaggtcttcatttctctgttgctctggatctctggtgcccacggggacatcgtgatgacccagtctccagactccctggctgtgtctcgtgggcagcgggccaccatcaactgcaagtccagccaacaattcttttaanactacgttaccaaactaatacgtaaaactactagtcttagaccagacagacgaccaggacacgcctacgtaggctgctactatttacgnggactacgtaccgtaacccgggtaacgtcccggggtacccctacgaccgtattaccgaggtcggacgcggggtccgggtacgtacgggactagttactttccactcctaccacctactacaacgcgacgtccgacgacgacgtacgaagtagtgtaggtacgtagtttagtttacgttagtacgtaaactaaattaatttaattattaacgttacgttacggtacggtaccggtacggaacggtaaacggtaacggtaacggtacgtaactacgtaacgaacgtaacgtacgtgtacgtacgtacaccg

SEQ ID NO: 430692 - DNA, 594 bp, Homo sapiens
  misc_feature: GZ8MTXP02HM6DX.19.71.G05.1.454.CMB.2.raw
  modified_base (219)..(219): a, c, t, g, unknown or other
  modified_base (233)..(233): a, c, t, g, unknown or other
  modified_base (240)..(240): a, c, t, g, unknown or other
  modified_base (242)..(242): a, c, t, g, unknown or other
  modified_base (248)..(248): a, c, t, g, unknown or other
  modified_base (250)..(250): a, c, t, g, unknown or other
  modified_base (252)..(252): a, c, t, g, unknown or other
  modified_base (257)..(257): a, c, t, g, unknown or other
  modified_base (260)..(260): a, c, t, g, unknown or other
  modified_base (266)..(266): a, c, t, g, unknown or other
  modified_base (268)..(268): a, c, t, g, unknown or other
  modified_base (284)..(284): a, c, t, g, unknown or other
  modified_base (293)..(293): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgaggcgggcctacgactacggacncgactaagcagcanatcttananatacanananaactntantgacananagacacacgacacgcncgtacgctnctctacttacgtcggcgactacgtaccggtacggtccggtccccgtacgtacgtacgtacgtacgtcggcgcggtcgggtacggtacggtacgtacgtactactactactactaccacacgacgacgacgtcgtacgacgacgacgtagagtagtaggtagtagttagtttattagtagtactaataattaattattacttacgttacgttacggtacggtaccggtaacggtaacggtaacggtaacggtacgtaagtacgtaacgtacgtaacgtacgtacgtacggtacgtacgtacg

SEQ ID NO: 430693 - DNA, 630 bp, Homo sapiens
  misc_feature: GZ8MTXP02HN3OF.19.71.G05.1.454.CMB.2.raw
  modified_base (242)..(242): a, c, t, g, unknown or other
  modified_base (476)..(476): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccacaattcttttanactagttaccaaacaatagaaaactacttaagcttaggtaccagcaagagaaccaaggacacgcctcgtaggctgctctatttacgtcgggctatccgtaaccccggggaagtcccggggtaccccctcggaaccgtacttacgaggtcggcacgggcggggttcctaggggacctagtaactttcacctacctccacctaacgtccagcacgccctgccgtagggcagaaagngtgtgggtattagtttattagttacaccaaatattattattactacgttcggtaggttaccggttcggaaccgtaacgggggtaaccaaagggttcggtaactaaagttaacgaacggtaaccgtaaacggttggtacggtcttacggtaaccc

SEQ ID NO: 430694 - DNA, 615 bp, Homo sapiens
  misc_feature: GZ8MTXP02FHIAS.19.71.G05.1.454.CMB.2.raw
  modified_base (239)..(239): a, c, t, g, unknown or other
  modified_base (251)..(251): a, c, t, g, unknown or other
  modified_base (378)..(378): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggcacgatacgactgactaagtccagccacaatctttanacagttcccaanaatagaaaactactagcttaggaccagcagacgacaggacacgcctcgtaggctgctctactttacgtcggcactaccgtaccggtaacggtaccggggtcccccgtcgaccgtactacagtggcgngcgggtcgtcgggacgagtatttactactacctacctaccactacacgacgacgccgtcgtacgacgacgtagaaagagtggtaggtacgtagtttatttagttacgttactaactaaattaattaattaacttacgttacgtacggtacggttaccggtaccggtaaacgggaaacgtaacggtacggtaagtaactaacgaacgaacgtaacgtacggtacggtacgtacgtacg

SEQ ID NO: 430695 - DNA, 608 bp, Homo sapiens
  misc_feature: GZ8MTXP02I54Q2.19.71.G05.1.454.CMB.2.raw
  modified_base (239)..(239): a, c, t, g, unknown or other
  modified_base (310)..(310): a, c, t, g, unknown or other
  modified_base (319)..(319): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccaacaattctttanacagttaccaacaatagaaaactactagcttaggtaccagcagagaccaggacagcctccgtaggctgctntatttacgngggcatccgtacccgggaatcccggggtcctagacctattcgagtgcaggcggggtctgggacagtatttcactctcacatcagcacgctgcaggctagaagtagtgtggtacttagtttattattagaactaaactaattatttaattaacgttacgtttacggtacggttaccggtttaccgggaaccgtaaaacgggggtaacctaaaggggttacggtaaacgtttaacaccggtaaagtaaacccggtaaacgttgggttacggacgttacggacctaaacccg

SEQ ID NO: 430696 - DNA, 637 bp, Homo sapiens
  misc_feature: GZ8MTXP02I6XPC.19.71.G05.1.454.CMB.2.raw
  modified_base (391)..(391): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgcctcacctgtcgccatccgtccggggacagagtcgctagcgacagtgttgcgttggctacgtgggtcaggccacgtccccatcggaggaggtctagaggtggcgtaggggaagactattatttcattcgtaccaaacgtacggtaggtaaataactaaaatttanacgactaacctattacgtgttagaaggtagtcgaactgaacaatacgaaacgtaagacaactataacgaaacgtaaacctacgtttacctacccgtagaccgacgtaccgtacgtaaccccttcgttacgtacccggacccgttaaaccccgggaaggggacccgttaaccggggttagtttaacgttaacgtttaccgtaagggttaccgggaaacggaccccggtaccccctaaagtaacccgg

SEQ ID NO: 430697 - DNA, 596 bp, Homo sapiens
  misc_feature: GZ8MTXP02H128P.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccagggactggtgaacgccctcgcagaccctctcgctcacctgtcgcccagtccgtccggggacagacgtcgctagcgacagtgttgcttggcacgtgggtcaggcacgtccccatcggagaggtctagagtggctaggggaagactagtatttcgattcggtaccaaacgacggtagaaataactaaaatttatacgaccctaactattcgtagttacgagtagtcgactagaacctatacaaacggtagacaaactactaacgaaacgaacctacgttaccctaccctaggacacgtactacgacccttgtacgtacgaacccgtacccggaacgggtaccgacgggttagttaactaacgttacgtaggtacgggaaacgtacccggacccctaagaacg

SEQ ID NO: 430698 - DNA, 702 bp, Homo sapiens
  misc_feature: GZ8MTXP02HMY3U.19.71.G05.1.454.CMB.2.raw
  modified_base (241)..(241): a, c, t, g, unknown or other
  modified_base (251)..(251): a, c, t, g, unknown or other
  modified_base (255)..(255): a, c, t, g, unknown or other
  modified_base (311)..(311): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccgatacgaactgacaagtcagccacatcttttanacataccaanatanaaactctagctagacagcagacgaccagacacgcctcgagctgctactatttacgnggacacgtaccgtaccgggtacgtcccggggtcccctacgaccgtattcgaggtcggacgtcggggtcgggttcgacgggtactacgttactttaccaccttcctacccgtaacctacgtaccgacgccgtacgtccgtacgcgaacgggtcgtaaggaaacgtcgttacgggtacggttacgttaaggttttaacgttacgttacgtaaacttaaacgttaaactttaactttaaacgtttaacgtttaccgtttacggggttacgggttaacccggtttaccggggtaaacccggtaaacgggggtaaccgttaaacgggggtacgttaacgttaacgtaaccggaacggttaaccggtacggttacgggttacggtaccgtacgaccg

SEQ ID NO: 430699 - DNA, 592 bp, Homo sapiens
  misc_feature: GZ8MTXP02J5E1H.19.71.G05.1.454.CMB.2.raw
  modified_base (304)..(304): a, c, t, g, unknown or other
  modified_base (319)..(319): a, c, t, g, unknown or other
  modified_base (356)..(356): a, c, t, g, unknown or other
  modified_base (404)..(404): a, c, t, g, unknown or other
tcagtactctcgtgcacgaccggtgctcgatttagtgtcgtcgcaagagagagggtaggtacaacaggcaggcagggcagcaagatggtgttgcagacccaggtcttcatttctctgttgctctggatctctggtgcccacgggacatcgtgatgacccagtctccagactccctggctgtgtctcgtggcgagccgggccaccatcaactgcaagtccagccacaatctttatacagttaccaacaatgaaactacttagcttggtaccagcagagaccaggacagcctcctaggctgctacntttactggtcgactntaccccgggaactccggggtcccccccgtgtacccgnttacagtggtccgagcggggttccttgggaccgaagatttactacccnctccaacccatcggagcaaggccctttgccaagggttgtgagagtagtgtgtagttatttattattactactaactaacttaattaattacttacgttacgttacggttacggtacggtacggtaccggtaccgtaacggtaacggtacggtaacgtacgtacgtacgtacgtacgtacgtacgtacg

SEQ ID NO: 430700 - DNA, 626 bp, Homo sapiens
  misc_feature: GZ8MTXP02HXZN9.19.71.G05.1.454.CMB.2.raw
  modified_base (228)..(228): a, c, t, g, unknown or other
  modified_base (237)..(237): a, c, t, g, unknown or other
  modified_base (250)..(250): a, c, t, g, unknown or other
  modified_base (256)..(256): a, c, t, g, unknown or other
  modified_base (259)..(259): a, c, t, g, unknown or other
  modified_base (278)..(278): a, c, t, g, unknown or other
  modified_base (301)..(301): a, c, t, g, unknown or other
tcagtactctcgtgcacgaccggtgctcgatttagtgtcgtcgcaagagagaggggggtacaacaggcaggcaggggcagcaagatggtgttgcagacccaggtctttcatttctctgttgctctggattctctggtgcccacggggacatcgtgatgacccagtctccagactccctggctgtgtctctggggcgagcgggccaccatcaactgcaagtccagccanatctttaanacatacaatatanaaactntanctgacagcagagacagacncgcctcagctgctatatttacgnggactacgtccgtaaccggtacgtcccgggtacctacggaccgtatcgaggtcggaccgagggtccgggtacgtacgggactagttactttcgacttcctacaacctactcgacgacgacgtccgtacgaccgaggtactagaagtagttggtagtacgtttaagtttacttagttacgtaactaaacgttaagtttaatttaacttaacgttaacgttacgttaggttaaccggttacggaaaccggtaaacgggtaacgtaaacggtacgtaaacttacgacgtaacggtaacgtaacgttcggtacgtacgtacgtaacacg

SEQ ID NO: 430701 - DNA, 535 bp, Homo sapiens
  misc_feature: GZ8MTXP02HKQXM.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatctccggggacagagtcgctagcgacagtgttgcttggcacgtgggtcaggtcacgtccccatcgagaggtctagagtggctggggaagactatatttcagttcgtccaacgacgtagaaatacgaaattatgacacatctggttagagagtcgactgaacaaatcaaacgtagacacatacgaaagtaacctacgttcctacctgacagtctacgaccctcgtacgtcgaccgtccggaacgacgacgggttatacgtaagttacgtgtacggaacgacggacccctaagtacg

SEQ ID NO: 430702 - DNA, 558 bp, Homo sapiens
  misc_feature: GZ8MTXP02FZ7H6.19.71.G05.1.454.CMB.2.raw
  modified_base (240)..(240): a, c, t, g, unknown or other
  modified_base (320)..(320): a, c, t, g, unknown or other
  modified_base (368)..(368): a, c, t, g, unknown or other
  modified_base (427)..(427): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccacaattctttanacagttccaacaatagaaaactacttagcttggtaccagcaagagaccaggacacgcctccgtaggctgctcatttacgnggcatccgaccgggtagtccggggtcccctgaccgtatcgaggtcgcnggtcgggtcgtgggacagtactttcgactctcaccatcagcagcctgcaggctagaagngtgtggtactagttttatagttcgtacaaataattattattatacgttgtacggtacgttcggaccgtaaagggacctaagggtcgtatacgtaacgacgtaacgtaacgtcggtacggtcctaggaaccc

SEQ ID NO: 430703 - DNA, 649 bp, Homo sapiens
  misc_feature: GZ8MTXP02JZAN2.19.71.G05.1.454.CMB.2.raw
  modified_base (240)..(240): a, c, t, g, unknown or other
  modified_base (324)..(324): a, c, t, g, unknown or other
  modified_base (388)..(388): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccacatcaactgacaagtccagccactaattcttttaanactacgttaccaaacaatagaaaacttctagcttggaccagcagacgaccaggacagcctccgtaggctagctactatttacgngggacagttccgtaacccggggacgtcccggggtccccctacgacccgtattcgaggtcggacngggtcgggtctggggacagtactttcactcctacacccatccagcgagccctgacgaggactagaaacgtgtggtacggtattaaggttttatttattacgtaacctaaaacttaatttaatttaagtttaactttacgttacgggttaacgggtaccggtttaccgggaaacccggttaaaaggggaccgtaaacggggtacgtaattacgaaccgtaaaggtaaccgtaaacggttgggtacggaccttaacggacccg

SEQ ID NO: 430704 - DNA, 636 bp, Homo sapiens
  misc_feature: GZ8MTXP02IIKI4.19.71.G05.1.454.CMB.2.raw
  modified_base (368)..(368): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatctccggggacagagtcgctagcgacagtgtgcttggcacgtgggtcaggcacgtccccatcgagaggtctagagtggcgtgggaagacactagttcatcgtccaaacacgtaggaaatacaaattntacgacacctatcgtagttgagtagtacggacttacgaaactaaactacgaaaacgttaacggaaacaacgaacgttacggaaaacgaaacccttacggtttacccttaccccttaggcctaaaggtccttacggaacctttaccgtacggttcggaaccccgttaccccgggaaacggtaacccgtaaccgggggtttgttaaacttaacgttttaccgtagggttaacggggaaacggtaacccgggacccccgtaaactaaacgg

SEQ ID NO: 430705 - DNA, 532 bp, Homo sapiens
  misc_feature: GZ8MTXP02I2O91.19.71.G05.1.454.CMB.2.raw
  modified_base (344)..(344): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccttgcagacccctctcgctcacctgtcgccatcgtccggggacagacgtcgctagcgacagtgttgcttggcacgtggtcaggcagtccccatcgagagtcagagtggctgggaagacatattcatgtcaaacncgtagaactaactaaattatgacaactatctgttagagtagtccgaatgaacaatacaaacgtagaacaacgataacgaaacgtaaccagttcctaccctgactagctcgaccctgtagtcgactccggaacggtaccgaggggtctaataacgttacgtaggtacggaacgaccggcccaagtaacg

SEQ ID NO: 430706 - DNA, 540 bp, Homo sapiens
  misc_feature: GZ8MTXP02I72F5.19.71.G05.1.454.CMB.2.raw
  modified_base (239)..(239): a, c, t, g, unknown or other
  modified_base (249)..(249): a, c, t, g, unknown or other
  modified_base (309)..(309): a, c, t, g, unknown or other
  modified_base (317)..(317): a, c, t, g, unknown or other
  modified_base (347)..(347): a, c, t, g, unknown or other
  modified_base (353)..(353): a, c, t, g, unknown or other
  modified_base (356)..(356): a, c, t, g, unknown or other
  modified_base (380)..(380): a, c, t, g, unknown or other
  modified_base (388)..(388): a, c, t, g, unknown or other
  modified_base (399)..(399): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatcaactgacaagtccagccacaatctttanacattccaanaatagaaaactacttagcttaggtaccagcagacgaccaggacagcctctaggctgctanatttacgngactatccgaccggagtccggcccagactntcgagngcnggtcggtcgaggacagtacttacnctcacacntcagcacgccngacgagatagagtagtgtagtattatttatattacgaactaaattaattatttacttattacgttggtacggttaccgtacggacgaaacgggtacgtaggtacagtaagcgaacgtacgtacgtaggacgtactacgacg

SEQ ID NO: 430707 - DNA, 722 bp, Homo sapiens
  misc_feature: GZ8MTXP02FSNXG.19.71.G05.1.454.CMB.2.raw
  modified_base (233)..(233): a, c, t, g, unknown or other
  modified_base (246)..(246): a, c, t, g, unknown or other
  modified_base (343)..(343): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgaactcgactaagtccagccanaattccttttaanactacttaccaaataataacgtaaactacttagtcttacgacagacaagacgaccgaggacacgtccctacgaggctcgtccttacgtagtttacgngggactacgttacccggtaacccggggtacggttccccggggttacctaccggtacccgtagttaccgtacggtcggacgtacggggtccggggtacgtacggggaacctagttacctttacgaccgttcctacctaaccgtactacgaacgtaccgaccgtccgtacgacgtacggtacgtagtaacgtagtaggtacggtacgttagtttaacgtttaagttaacgtaacgtaaacgttaaattaatttaacttaacgttacgttacgttacggttaccggttaccggtaaaccggtaaacgggtaacggtaaacggtaacgtaacgtacgtaacgtaacgtaacgtaacgtacggtacggtacgtacgtacgtacg

SEQ ID NO: 430708 - DNA, 555 bp, Homo sapiens
  misc_feature: GZ8MTXP02IY68T.19.71.G05.1.454.CMB.2.raw
  modified_base (239)..(239): a, c, t, g, unknown or other
  modified_base (306)..(306): a, c, t, g, unknown or other
  modified_base (313)..(313): a, c, t, g, unknown or other
  modified_base (359)..(359): a, c, t, g, unknown or other
  modified_base (374)..(374): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccgatcaactgacaagtccagccacaatctttanacagttccaacaatagaaaactactagcttggtaccagcagagaccaggacagcctctaggctgctnatttacnggcatctacccgggaatccggggtcccctgaccgattcgagtggcnggcgggtctgggacngactttcactctcacatcagcagcctgcaggctagaagatggtaggtatagtttatatacgtacaaataattaattaattaacttacgttacggtacggtaccgttacggaaccgtaaacgggtaaccgtaagggtacgtaataacgtaacgaaagaacgtaacgtgtacggtactacgac

SEQ ID NO: 430709 - DNA, 665 bp, Homo sapiens
  misc_feature: GZ8MTXP02F84F8.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccagtccgtccggggacagagtcgctagcgacagtgttgcttggcacgtggtcaggccacgtccccatcgagaggtctagagtggcgtaggggaaaggacaattatttcattcgtccaaacgacgtaggtaaactaacgtaaaatttatacgacaaccctattcgtaggttagaagtacgtcgtaactagaaactaaagtaccgaaaacgtacgaaacctaactaagtaccgaaaacgtaaacccgtacgtttacccgtaccccgtaggaccaccggtaccttacggtaaccccttcgtaccggttaccgtaaccccgttaccccgggaaacgggtacccgtaacgggggttactttaaaacgtttaacgtttacggtaacggttaaacggggaaaccgtaacccgggaaccccctaagttaaaccgg

SEQ ID NO: 430710 - DNA, 639 bp, Homo sapiens
  misc_feature: GZ8MTXP02H1NZY.19.71.G05.1.454.CMB.2.raw
  modified_base (228)..(228): a, c, t, g, unknown or other
  modified_base (238)..(238): a, c, t, g, unknown or other
  modified_base (250)..(250): a, c, t, g, unknown or other
  modified_base (262)..(262): a, c, t, g, unknown or other
  modified_base (317)..(317): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccgacggggacatcgtgatgacccagtctccagacctccctggctgtgtctcgtgggcaggcgggccaccatcaactgcaagtccagccanaattctttanacagttaccaanaatagaaaactntagcttaggaccagcagagaccaggacagcctacgtaggctgctctaatttacgngggcagtccgtaacccggggtaagtccccggggtacctcgacccgtattccgaggtcggccaggtccggggtctagggacctagtactttcgacttctaccaccatcacgcagccctgcgaaggctagaagtagtggtacggtacttaagttttaattagtttacgtaactaaaacttaatttaatttaatttaacgttaccgtttacggtacggttaacggttacccgggtaaccggtaaacggggtaaaccgtaaaggttacggtaacttacgtaacgaacggtacggtaaactgggtacgaccgttacgacctaacccg

SEQ ID NO: 430711 - DNA, 678 bp, Homo sapiens
  misc_feature: GZ8MTXP02GHU22.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctccacctgtcgccatcgtccggggacagagtcgctagcgacagtgttgcgttggctacgtgggtcaggccacgtccccagtcgagaggtctagagtggcgtaggggaagactagttactttcattcgtacccaaacgtaacggttaggaaaacttaacgtaaaatttagtacgaccctaaacctagttcgttagggtttagaaggtacgttaccggaacttacggaaactaaacgttacgaaaacgttacgaaaccaacgtaaacgttaacccggaaaacggtaaaccctaacggtttccccttacccgtggaccgtagtaccgtacgtaacccgttcgttacggtaccgtacccgttaccccgggaggtaacccgtacggggttattaacgttaacggttaccgtagggtaaccgggaaacggtacccggtaccccgtaagtaaccgg

SEQ ID NO: 430712 - DNA, 571 bp, Homo sapiens
  misc_feature: GZ8MTXP02FM7CB.19.71.G05.1.454.CMB.2.raw
  modified_base (227)..(227): a, c, t, g, unknown or other
  modified_base (236)..(236): a, c, t, g, unknown or other
  modified_base (302)..(302): a, c, t, g, unknown or other
  modified_base (308)..(308): a, c, t, g, unknown or other
  modified_base (362)..(362): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaacaatagaaaactacttagctgtaccagcagagaccaggacagcctctaggctgctnattacngggcagtcgtacccgggatcccggggtcctcgaccgatcagtgcagcggggtcngggacagactttcactctcacatcagcagcctgcaggctaggaagtagtcggtggtactaagttttattagttagtaaccaaataattaatttattaattaacgttcggtacggttaccggtttacggaccgtaaaacggggtaccgtaaagggtaggtaacttaagtaccgaagtaaccggtaacgtggtacggactacgcctaaccg

SEQ ID NO: 430713 - DNA, 741 bp, Homo sapiens
  misc_feature: GZ8MTXP02HIPHH.19.71.G05.1.454.CMB.2.raw
  modified_base (229)..(229): a, c, t, g, unknown or other
  modified_base (239)..(239): a, c, t, g, unknown or other
  modified_base (249)..(249): a, c, t, g, unknown or other
  modified_base (253)..(253): a, c, t, g, unknown or other
  modified_base (259)..(259): a, c, t, g, unknown or other
  modified_base (290)..(290): a, c, t, g, unknown or other
  modified_base (294)..(294): a, c, t, g, unknown or other
  modified_base (307)..(307): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggccacgatacgactgacaagtcagccanaattctttanactatacaanatanaaactntagctgacagcagacgacagacacgcctcgngctnctactagtttcgnggactacgtaccgtaacccgggacgttcccgggtaccccctacggaccgtacttacgacggtcggacgtcggggtccggggttacgtacgggggtaaacctaggttacctttacccgtaccgttaccctacccgtaacccgtacgtaccgacgtaccgtaccgtaccgtacggtacgtacggtacggtacggtaaacggtaacggttacggttacggttaacgtttaacgttttaacgtttaacgtttaacgttaaccgttaaaacgttaaacgtttaaatttaaacgtttaacgtttaacgtttacggttacgggttaaccgggttaaccgggttaaccggtaaaccggggtaaaccgggttaacgggtaacggtaacgttaacggtaacgtaacggtaacggtaacggttacggtacggtacgtacgtaccg

SEQ ID NO: 430714 - DNA, 705 bp, Homo sapiens
  misc_feature: GZ8MTXP02ITGQX.19.71.G05.1.454.CMB.2.raw
  modified_base (254)..(254): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacaggngtcgctagcgacagtgttgcttggcacgtgggtcaggcacgtccccagtcgagaggtctggagtggctggggaacgactagtatttcgattcgaccaacgtacggttacggaaaacttaccgtaaaaagtttactacgaccctaaaccctagtttaccgttaggtttaggaaacgggtaacggttaccggaacctttaacgggaaaccctaaacgttaccgaaaaccggttaaacggaaacctaaaccgtacgttaaccggaaaaacgttaacccgtaaacggtttccctaaccccgtggacccgtacggtccttacggtaacccttcgtacggttaccggaacccgttacccgggacgggtaacccggtacggggttagttaaacgttacgtttaacgtagggtaacgggaaaccggtacccggtacccccgtaagttaaaccggaaccg

SEQ ID NO: 430715 - DNA, 669 bp, Homo sapiens
  misc_feature: GZ8MTXP02GOCWT.19.71.G05.1.454.CMB.2.raw
  modified_base (330)..(330): a, c, t, g, unknown or other
  modified_base (350)..(350): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcagtgggtcaggcacgtccccagtccgagaggtctaggagtggcgtagggaagactattattcatcgtaccaanacggtagaactacaaatttnacgacaccatccgtagttgacgtagtacgacttacgaactaaatacgaaacgtacgaactaacaagtacgaaacgtaacctacgtttccaccccgtgaccgtacgtccgtacggtaccttacgtacggtaccctaaccgtacccccggggtaaggtaacccgggtaacggggttagttaacgttaacgtttaacggtacggggttaacggggtaaaccggacccggggtacccccgtaaagttaaccggaacctaacgttccggaaccccgttaaccgttccgttaccgtttccggtaggttcgtaaccgtttaacggg

SEQ ID NO: 430716 - DNA, 663 bp, Homo sapiens
  misc_feature: GZ8MTXP02GV6P9.19.71.G05.1.454.CMB.2.raw
  modified_base (311)..(311): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagacgtcgctagcgacagtgttgcttggcacgtgggtcaggcacgtccccagtcgagnggtctagagtggcgtaggggaagactattattacattcgtccaaacgacggtaggaaattaacgtaaatttatcgactaccgtattcgttaggttagaagtacgtcgaacttagaaactaaacgtacgaaaacgtacgaaactaacgaagttaaccggaaacgtaaacccgtacggttaccctacccgaacggacaacgtccgtaccgtaacccttccgttacgggtaccgtaccccgtaacccgggaacgggtaacccggtaaccggggttaggtttaaacttaaacggtttaacccgtagggtttaaacggggaaaccggtaaccccgggtaccccctaagttaaaccgg

SEQ ID NO: 430717 - DNA, 587 bp, Homo sapiens
  misc_feature: GZ8MTXP02GZ1SE.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccagtcgagaggtctagaggtggcgtaggggaaggactagttatttcagttcgtaccaacgacggtaggaaactaactaaattatgacacctatcgtggttagagtacgtcgaactagacaaatacaaacgtagaacacagtacgaaacgaacctagttacctccctcgacacgtcctcgtacctcgtacgtacgaccgtacccggaggacgacgggttagtaagtagttacgtacggtaggaacgtacggaccccaagtacgactacgtacgaaccgtaccgtcgttacctcgtcggtcgtacgttaacgg

SEQ ID NO: 430718 - DNA, 536 bp, Homo sapiens
  misc_feature: GZ8MTXP02F8JNP.19.71.G05.1.454.CMB.2.raw
  modified_base (249)..(249): a, c, t, g, unknown or other
  modified_base (366)..(366): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgcccatctccgggganagagtcgctagcgacagtgttgcttggcactgggtcaggcagtccccatcgagaggtctagagtggcgtggggaaggacagtatttcatcgtaccacgacgtggaaatacaaattangacacatctgtgagagtcactgacaatacaacgtagacacatacgaagaacctagttacctccctagcacgctacgaccttcgtcgtacgacctcccggaggaccgtacggggttacgtattaacgttaacgtggtaacgggacgtaccggaccccctaagtacggtaac

SEQ ID NO: 430719 - DNA, 574 bp, Homo sapiens
  misc_feature: GZ8MTXP02JWHZZ.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcaggtccccagtcgagaggtctaggagtggcgtaggggaacggactagttatttcatcgttaccaacgacgtaggaaattaactaaattatacgacacctattcgtgttagagtagtacgactagaacaatacgaacgtaagacacatacgaaagacctagttcctaccgtagacagtctacgacctcgtacgtacgaccgtacccggaaggtacgtaccggggttattaacgttacgttaacgtagggttaacggaacgaccggacccccttaagtacgtaaccg

SEQ ID NO: 430720 - DNA, 668 bp, Homo sapiens
  misc_feature: GZ8MTXP02IX143.19.71.G05.1.454.CMB.2.raw
  modified_base (238)..(238): a, c, t, g, unknown or other
tcagtactctcgtgcacgaccggtgctcgatttagtgtcgtcgcaagagagaggggggcagagtctgctgaattctggctgaccagggcagtcaccagagctcaagacaatgtctgtctccttcctcttcttcctgccgtgctggcctcccacaaggtgtcctgtcacaagtacagctgcagcagtcaggtccaggactggtgaacgccctcgcacgacccctctcgctcacctgtcnccatcgtccggggacagacgtcgctagcgactagtgttgcttggcacgtggtcaggcacgtccccagtcgagagtctagagtggcgtaggggaacgactattatttcattcgtaccaaacgacggtaggaaataactaaattatacgacctaactattacgttagttagaagtacgttacgaacgttaacggaaacctaaagtactaaaaccggttaacaaaccaaccgtaacgttaaaccgaaaacggtaaacccttaaccgttacccgtaccccttagaccgtaacgtccgtacggtaaccccttcgtaccggttaccgtacccgtaaccccgggtaaaggtaacccggtacggggttaactttaacgttaaccgtttaacggtacggttaacggggaacggtacccggacccccgtaataaacccgg

SEQ ID NO: 430721 - DNA, 712 bp, Homo sapiens
  misc_feature: GZ8MTXP02I6LDJ.19.71.G05.1.454.CMB.2.raw
  modified_base (243)..(243): a, c, t, g, unknown or other
  modified_base (325)..(325): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccaccatcaactgacaagtccagccactaattctttanacagttaccaaacaatagaaaactatagcttaggaccagacagacgaccaagacacgcctactaggctgctactatttacgnggactacgtccgtaaccccggggagtcccggggtacccctacggaccgtactttaccgaggttcggaccgtagggggtccggggttacgtagggggaaccttaacggtacttttaccgaacccttaccctacccaaaccccgtaattccgaaacgtcccgaacggtcccgtacggacgtaacgggaccgtaggtaaaacggtacgttgggtacggtactttaggttttaacttagttacgtaaactaaacttaaatttagttttaacttacgttacggtttcggtaacgggttaccggtttacgggaaacccgtaaaaggggacccggttaagggtaacggtattaacgaacgaaggtaaccgtacgtggtacggacttacgacccg

SEQ ID NO: 430722 - DNA, 585 bp, Homo sapiens
  misc_feature: GZ8MTXP02FROVG.19.71.G05.1.454.CMB.2.raw
  modified_base (240)..(240): a, c, t, g, unknown or other
  modified_base (320)..(320): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacatcgaactgacaagtccagccacaattctttanacagttaccaaactaatagaaaactcttagcttaggtaccagcagagaccaggacagcctcctagctgctctatttacgnggcactccgaccggacgtccgggtcccctgaccgtatcgaggtcgcgtggcgggtcgaggactagttacttcactctcaccatacgagcacgcctgcgagactagaagtagtggtagtacttagtttattagtataacgaaacttaatttaagttattacgttacgttacggtacggtaccggttacggaacgaaagggtaaccgtaagggtacgtaagttaacgtaacgaacggtaacgtacgtaggtcggtaccgtacgtacg

SEQ ID NO: 430723 - DNA, 550 bp, Homo sapiens
  misc_feature: GZ8MTXP02JLXIH.19.71.G05.1.454.CMB.2.raw
  modified_base (241)..(241): a, c, t, g, unknown or other
  modified_base (434)..(434): a, c, t, g, unknown or other
  modified_base (438)..(438): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgaggcgggccaccgatcgaactgcaagtccagccacaatcttttanacagttccaacaatagaaaactacttagcttggtaccagcagagaccaggacagcctcctaggctgctcatttactgggcagtccgtaaccccggggaattcccggggtccccctgacccgtattcaggtggcaggcgggtctggggacagtatttcactctcaccatcagccagccctgccaggctagaaantggnggactaggtttatagttgtacaactaatatttaattataaccttgtacggtaacgttccggacgaaacgggtaccgaagggtcgaatatcgagaacgaactgtcggtcacgc

SEQ ID NO: 430724 - DNA, 604 bp, Homo sapiens
  misc_feature: GZ8MTXP02GUSZ9.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatccgtccggggacaggagtcgctagcgacagtgtgcttggcactgggtcaggcacgtccccatcgagaggtctagagtggcgtaggggaacgacatatttcatcgtaccaacgtacgtaggaaattaacaaaattatacgacaacctatctgttagagagtacgactagaacaatacgaacgtaagaacaacaagtacgaaaacgaaccgtaagttacctacccgtacgtacaacgtcgttacgaccttcgtacggtacgtaccgttacccggaacggaaccggtaccggggttaacttaagttaacgtttaaccgtggttaacggggaaacggtaaccgggtacccccaaagttaaccggtaaaccg

SEQ ID NO: 430725 - DNA, 646 bp, Homo sapiens
  misc_feature: GZ8MTXP02IJTQW.19.71.G05.1.454.CMB.2.raw
  modified_base (253)..(253): a, c, t, g, unknown or other
  modified_base (346)..(346): a, c, t, g, unknown or other
  modified_base (411)..(411): a, c, t, g, unknown or other
  modified_base (443)..(443): a, c, t, g, unknown or other
  modified_base (467)..(467): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtggggcgaggccgggccaccgatacgaactgacaagtccagccaactaattcttttanacacgttaccaaacaataagtaaactcttagcttacggaacagacagaacgaccaggaccacgtccctcgaggctagcttactagttttacgngggctacgtaccggttaacccggggacgtcccggggtcccctacgaccgtattcgaggttcggcnggggtcggtagcgacgagttcttccacttccncaaaccctatcgacgacgacgtcncgacgacgtacgtagagtagtgtagtagttagttagttattagtaactaaacttaattaatttaattaacgttacgttacggttacggtacggttaccggtaacggtaaacggtaaacggtaacgtaacgtaagtaacgtaacgtaacgtaacgtacgtacggtacgtacgtacgtacg

SEQ ID NO: 430726 - DNA, 658 bp, Homo sapiens
  misc_feature: GZ8MTXP02H2GYS.19.71.G05.1.454.CMB.2.raw
  modified_base (254)..(254): a, c, t, g, unknown or other
  modified_base (267)..(267): a, c, t, g, unknown or other
  modified_base (344)..(344): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccacggggacatcgtgatcgacccagtcctccagacctccctggctgtgtctcgtgggcgagccgggccacgatacgaacgtgactaaagtccagaccaactaattcttttaanactacgtaccaanaataacgaaactactagtcttacgtaccagacaagacgaccaaggacacgtcctacgaggctgctactagtttacgnggactacgtacccggtaaccgggtacgtcccgggtcccctacgacccgtgttacgaggtcggacgcggggtcgggtcgtacgggactagttacttccactccacaccctatacacgacacgtcctcgacgacgacgtagaagtagtagtggtacgttagtttattattacgtactaaacttaaattaatttaatttaacgttacgtttacggttacggttacggttaccggtaaccggtaaacggtaacggtaacggtacggtaacgtaacgtaacgtaacgtaaacgtaacgtacggtacgtacgtacgtacg

SEQ ID NO: 430727 - DNA, 533 bp, Homo sapiens
  misc_feature: GZ8MTXP02IP154.19.71.G05.1.454.CMB.2.raw
  modified_base (237)..(237): a, c, t, g, unknown or other
  modified_base (420)..(420): a, c, t, g, unknown or other
  modified_base (423)..(423): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttggtaccagcagagaccaggacagcctccaggctgctcatttactggcatctacccggggaatcccggggtcccctgaccgattcgagtggcaggcgggtctaggggaccaagtatttcactctacaccatcagcagcctgcagctgaaagntgngtctagtttatatgactaaataatattattatacttcgtagacgttcggacctaaagggaccaaggttacggattacgtaacgagtaacgaacgtgtaccgagtcgaacc

SEQ ID NO: 430728 - DNA, 709 bp, Homo sapiens
  misc_feature: GZ8MTXP02JJU1R.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagaggtctaggagtggctaggggaaggactattatttcaattcgtaccaaacacggtaggaaactaaccaaaatttatacgaccaaccctaattccgttaggtttacggaaggtacgttaccgaacttaggaaacctaaaacgttaccgaaaaccggttaagaacctaactaagttaaccgaaacgaaacccgtaacggtttccctacccccgttaggacctaacggtccgttaccggtaaccccttcgttacggttaccgaacccgttaccccgggaaggggtaaccgtacgggggttactttaaacgttacgtttaaccgttacggggttacgggtaaaaccggtaccgggaccccccgtaagttaacggaacctacgtacggaaccccgtaaccgtccgttacctcgttacggtgtaccgtttaag

SEQ ID NO: 430729 - DNA, 641 bp, Homo sapiens
  misc_feature: GZ8MTXP02H1O83.19.71.G05.1.454.CMB.2.raw
  modified_base (203)..(203): a, c, t, g, unknown or other
  modified_base (267)..(267): a, c, t, g, unknown or other
  modified_base (368)..(368): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaacgccctgcacgaccctctcgctcacctgtgccatcgtaccggggacagagtcgctagcgacngtgtgcttggcacgtgggtcaggccacgtccccagtcggagtggtacaggagtggcgtaggggacgactatatttcattcgtcagcgtagaatacaaattngcacctatcgtgttagagtacgtactaacttaacaacttaccgaaacgttacgaactaacgtaactacgggaaaactaaccgtacggtttaccctcccgtagacctacggtaccgttaccgtaacccttcgtacggtaccgtaacccggttaccccggaaagggtaacccggttaacgggttacgtttaacgtttaaccgttaacggttaagggttaaccggggtaaaaccggcccgggtaaccccctaaaggttaacccggtaactaaccgg

SEQ ID NO: 430730 - DNA, 582 bp, Homo sapiens
  misc_feature: GZ8MTXP02FRS19.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatctccggggacagagtcgctagcgacagtgttgcttggcacgtgggtcaggccagtccccagtcgagaggtcagagtggctggggaagacatattcattcgtccaacacgtaggaaatacaaaatttctgacacctatctgttagagtagtcgactagaacaaatcaaacgtagaactacaatacgaaacgaaacctacgttacctaccctagaccaagaccgtcgaacccttcgtacggttacgacccgttacccggaacggtaaccgtaaccggggttacttaagttaacgtttacgtaggttacgggaaacggaccggtaccccctagtaaaccgg

SEQ ID NO: 430731 - DNA, 584 bp, Homo sapiens
  misc_feature: GZ8MTXP02FH4IK.19.71.G05.1.454.CMB.2.raw
  modified_base (237)..(237): a, c, t, g, unknown or other
  modified_base (309)..(309): a, c, t, g, unknown or other
  modified_base (370)..(370): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagccagccacaatctttanacagttcaacatgaaactacttagctggtaccagcagagaccaggacagcctcctaggctgctctatttacngggcactccgtacccggggaatcccggggtcccccctggacccgattccgaggtcggccgngggccgggtcgtggggacagttactttccaacttctaccacctatacgagccacgcctgacgacggctaggaaagtgtggtggacttagtttattattagtacaaacttaattattaacttatacgttacggtacggtacgttacggaccgtaacgggaacgtagggtacggaattacaacgaacggaaccgtaacgtggtacggcctagaccc

SEQ ID NO: 430732 - DNA, 570 bp, Homo sapiens
  misc_feature: GZ8MTXP02JAJ5Q.19.71.G05.1.454.CMB.2.raw
  modified_base (308)..(308): a, c, t, g, unknown or other
  modified_base (348)..(348): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagngtctagagtggctggggagacatatttcattcgtccaaanacggtaggaaatacaaaatttatgacacctatctgttagagagtcgatgacatacgaaagtagacacatacgaaagaacccagttcctacccgtagaccagtacctacgtaccctcgtacgtacggtacccgtacccggaaacgggaccgtaacggggttagttaacgttaacgtttaacggtaggttaacgggaaacgtaccggaccccctaagtaaacgg

SEQ ID NO: 430733 - DNA, 620 bp, Homo sapiens
  misc_feature: GZ8MTXP02IAFQV.19.71.G05.1.454.CMB.2.raw
  modified_base (310)..(310): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctgcacgaccctctcgctcaccctgtgcccatcgtccggggacagacgtcgctagcgacagtgttgcttggcacgtgggtcaggcacgtccccatcgagngtctagagtcggcgtagggaagactatatttcattcgtaccaaacgtacggtagaaactaactaaaatttatacgaccaacaattcgttagttagaagtacggttacgactagaactaagtacgaaacgttagaaccacaagttacggaaagtaaccctaagttcctacccgtgacctaacggtcctacggaacccttcgtcggttacggaacccgttaccccggaaggtaacccgtacggggttaagttaacttaaccggttaaccgtaggttacggggaaacgtacccggaccccctaaaggtaaccg

SEQ ID NO: 430734 - DNA, 628 bp, Homo sapiens
  misc_feature: GZ8MTXP02HA6HE.19.71.G05.1.454.CMB.2.raw
  modified_base (243)..(243): a, c, t, g, unknown or other
  modified_base (255)..(255): a, c, t, g, unknown or other
  modified_base (319)..(319): a, c, t, g, unknown or other
  modified_base (361)..(361): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacgatacgaacgtcgacaagtccagccacaatcttttanacagttaccaanaatgaaaactacttagcttggaccagcagagaccaggcagcctactaggctgctcatttaccgnggacacgtaccgtaccggtacgtccgggacccctacgacctntacgaggtcggcgcgggtcgggtacgtagggactagtactttccaccttacctccaacccgactacgacgacgacgccgtcgacgacgacgtacgaagtagtggtcggtacgttagtttagttattacgtaactaacttaacttaatttaatttaacgttacgttacggttacggtacggttaccggtaaccggtaacgggtaacggtaacggtacgtaacgtaacgtaacgtaacgtaacgtacgtacgtacggtacgtacgtacg

SEQ ID NO: 430735 - DNA, 727 bp, Homo sapiens
  misc_feature: GZ8MTXP02IAPFJ.19.71.G05.1.454.CMB.2.raw
  modified_base (242)..(242): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcaggcgggccacgatacgaactgacaagtccagccactaattcttttaanacagttacccaaacaatagaaactactagcttaggaccagacagagaccagacacgcctccgtaggctgctctaagtttacgtcgggctaacgttaccgtaaccccggggaaacgttccccgggggtacccttaccggaccccgtaatttccgaggttcggaccggacgggtcccggggttcgtacggggaacctaacggttaaccgtttttaccaacctttcctacccctaaccaacgttcaacgaccgtaaccgtcccgtacggacgaacgggtacgtaaggtaaacgtaggttgggtacggttacgttttaagttttaagtttacgttaacgttaaactaaaacttaaatttaactttaatttaacgttacgttacggttacggttaccggttaccgggtaacggtaaacggtaacggtaaacggttacgtaacttaacgtacgtaaacgtaacgtaacgtcggtacgtcgtacgtactacg

SEQ ID NO: 430736 - DNA, 585 bp, Homo sapiens
  misc_feature: GZ8MTXP02G3V7Q.19.71.G05.1.454.CMB.2.raw
  modified_base (237)..(237): a, c, t, g, unknown or other
  modified_base (250)..(250): a, c, t, g, unknown or other
  modified_base (316)..(316): a, c, t, g, unknown or other
  modified_base (382)..(382): a, c, t, g, unknown or other
  modified_base (392)..(392): a, c, t, g, unknown or other
  modified_base (397)..(397): a, c, t, g, unknown or other
  modified_base (405)..(405): a, c, t, g, unknown or other
  modified_base (410)..(410): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacgggacatcgtgatgacccagtctccagacctccctggctgtgtctcgtgggcgagcgggccaccatcgaactgcaagtccagccacaatctttanactagttaccaanaatagaaaactcttagcttaggtaccagcagacaccaggactagcctctaggctgctcagtttacngggactatcccgtaaccgggaatccccggggtcctacggaccctattcgagtggaccaggcgggtntgggacagtntttcnctcacacnacacncacgcgcgacgacgacgagagtagtagtgtagtagttagttattagtactaactaattaattaattattacgttacgttacggtacggttacggtacggtaacggtaacggtaacggtacgtaacgtacgtacgtaacgtaacgtaacgtacggtacggtacgtacgtacgtacg

SEQ ID NO: 430737 - DNA, 556 bp, Homo sapiens
  misc_feature: GZ8MTXP02G8LED.19.71.G05.1.454.CMB.2.raw
  modified_base (241)..(241): a, c, t, g, unknown or other
  modified_base (326)..(326): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattctttanactagttaccaaacaatagaaaactacttagcttaggtaccagcagagaccaggacacgccctactaggctgctactatttacgngggctagtccgtaacccggggaatcccccggggtaccctgaccgtattcgagttcgcgaggcgggtcgtagggacagtactttccactctacaccatcagcacgcctgccagctagaagtatggtgactagtttatagttgactaaactaattattattatacgttacgtcggtacgttacggacgaacggacgtaaggtgaataagtacagacaacgtgtacggactcg

SEQ ID NO: 430738 - DNA, 600 bp, Homo sapiens
  misc_feature: GZ8MTXP02HGHFX.19.71.G05.1.454.CMB.2.raw
  modified_base (244)..(244): a, c, t, g, unknown or other
  modified_base (257)..(257): a, c, t, g, unknown or other
  modified_base (263)..(263): a, c, t, g, unknown or other
  modified_base (282)..(282): a, c, t, g, unknown or other
  modified_base (319)..(319): a, c, t, g, unknown or other
  modified_base (382)..(382): a, c, t, g, unknown or other
  modified_base (433)..(433): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctcagactcctggctgtgtctcgtgggcgagccgggccaccatacaactgacaagtccagccaataattcttttaanactactaccaaanaataanaaactatatctacgacagnagacacagacacgcctcgagctgctactagtttacgnggactacgtaccgtaacccgggtacgtcccggggtacccctacgaccgtatcgaggtcggacncgggtcggtcgtacgggacagtacttcactctaccacactcacacgacgcncgcgagacgagaagagtgtgtagtagtttattatagtaactaaataaattaattaattattaacgttacggttacggtacggttacggtaaccggtaaacggaaacggtaacggtacggtaagtaacgtaacgtaacgaacgtaacgtacgtacgtacgtacgtacg

SEQ ID NO: 430739 - DNA, 533 bp, Homo sapiens
  misc_feature: GZ8MTXP02HDDPL.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggccagtccccatcgagaggtctagagtggcgtgggaacgacatattcatgtccacacgtaggaatacgaaattatgacaccatctagtgagagtacgactgaacaatacaacgtagacacatacgaacaaccgtagttacctccgtagacagtcctacgacctgtacgcgaccgtcccggaagaccgtagggtactacttaagttaaccgtggtaacggacgaccgacccctaggtaacaaccg

SEQ ID NO: 430740 - DNA, 580 bp, Homo sapiens
  misc_feature: GZ8MTXP02INDP5.19.71.G05.1.454.CMB.2.raw
  modified_base (227)..(227): a, c, t, g, unknown or other
  modified_base (235)..(235): a, c, t, g, unknown or other
  modified_base (237)..(237): a, c, t, g, unknown or other
  modified_base (244)..(244): a, c, t, g, unknown or other
  modified_base (253)..(253): a, c, t, g, unknown or other
  modified_base (269)..(269): a, c, t, g, unknown or other
  modified_base (294)..(294): a, c, t, g, unknown or other
  modified_base (302)..(302): a, c, t, g, unknown or other
  modified_base (336)..(336): a, c, t, g, unknown or other
  modified_base (386)..(386): a, c, t, g, unknown or other
  modified_base (493)..(493): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccaggggacatcgtgatgacccagtctccagactccctggctgtgtctcgtggggcgaggcgggccacgatcgactgacaagtcagccanattcttananattcaanatgaaactntagctagacagcaganaccaggacagcctcgtagctagctntatttcgngggctagtaccgtaccgggaactccggggtcccngacccgtattcgaggtcggacacgggtcgggggttacctagggggaaccnggttactttcaaccttctacacctatcgagcacgcctagacgagggctagaaggtatggtacgagttaagttttataggttctaaacaaataatttagttaaatttnttacgttgtacgtacggttacggacgaaacgggtactaaggtacgaattacgacgaagtaacgtagttcggtacgtctacgactacg

SEQ ID NO: 430741 - DNA, 582 bp, Homo sapiens
  misc_feature: GZ8MTXP02JS0ZD.19.71.G05.1.454.CMB.2.raw
  modified_base (384)..(384): a, c, t, g, unknown or other
  modified_base (437)..(437): a, c, t, g, unknown or other
  modified_base (463)..(463): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgtgcttggcacgtgggtcaggcacgtccccagtcgagaggtctagagtggcgtaggggaagactagttaatttcattcgtccgaaacacggtaggaaataacgtaaaatttacngaccaacagttcgtgttagagtacgtcgactgaacaatacgaaagtagaacanagtacgaaacgaacctagtcctaccngacagctagacccttcgtacgtacgacccgtaccggaaggtaccgtaacgggggttattaacggttaacttacggtaggttaacgggaaacggtacccggtaccccctaagtaaaccgg

SEQ ID NO: 430742 - DNA, 650 bp, Homo sapiens
  misc_feature: GZ8MTXP02HL5DK.19.71.G05.1.454.CMB.2.raw
  modified_base (404)..(404): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccaccgatacgaactcgacaagtccagccaactaattcttttaatacagttacccaaacaatacgaaaacttcttagcttggaccagcagagaccaggacacgcctcctaggcctgactctatttacgtggctacgtacccgtaacccggggtagtccccggggtccccctaggaccgtatttacgaggtccggacncgggggtccgggttcgaggggtaccagttactttcgaccttcctacacccgatccgagcctacgccgtgccgaggactaggaagtagtggtacggtattagtttttatagttacgtaacaaattaatttaattaactttagttacgttcggttacggtaaccggtttcggaaccggtaaacggggtaactaggggtacgaattacgtaacgaacgtaacggtacgtggtaccgggtactagtcccg

SEQ ID NO: 430743 - DNA, 564 bp, Homo sapiens
  misc_feature: GZ8MTXP02HVF73.19.71.G05.1.454.CMB.2.raw
  modified_base (308)..(308): a, c, t, g, unknown or other
  modified_base (371)..(371): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatccgtccggggacagagtcgctagcgacagtgtgcttggcacgtggtcaggcacgtccccatcgagngtctagagtggcgtgggaagactattatttcattcgtccaacgacgtaggaattaacaaattntgacactatctgtagagagtcgactgaactaatacgaaagtagacacagtacgaacgaacctagtcctaccgtgacacgtctacgtacctcgtacggtcgacccgtcccggaacgtaccgtaacggggttattaacgttaagtttaccgtagggttaacggaaacggtaacccggtccccctaagtaaaccgg

SEQ ID NO: 430744 - DNA, 598 bp, Homo sapiens
  misc_feature: GZ8MTXP02J1XJ4.19.71.G05.1.454.CMB.2.raw
  modified_base (376)..(376): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctctcgctcacctgtcgccatcgtccggggacagagtcgctagcgacaggtgttgcttggcacgtgggtcaggcacggtccccatcgagaggtctagagtggctaggggaagctagtatttcattcgtccaaagacgtaggaaatacaaagtttanacgacactatcgttagtagagtacgtacgactagaactaagtacgaaacgtacgaacacgacgtaacgaaacgaaccttacgttaccctaccgtacgacgtacgtacgtacgtacccttcgtacggtaccgaccgtacccggaacggtaccgtaacgggttattaaacgttaacgttaacggtagggtaacggtaaccggtacccggtacccgtaagtaacg

SEQ ID NO: 430745 - DNA, 567 bp, Homo sapiens
  misc_feature: GZ8MTXP02HLF34.19.71.G05.1.454.CMB.2.raw
  modified_base (289)..(289): a, c, t, g, unknown or other
  modified_base (419)..(419): a, c, t, g, unknown or other
  modified_base (472)..(472): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcacgtggtcaggcagtccccatcgagaggtctagngtggcgtaggggaagactatatttcatcgtaccaacgacgtaggaactaacaaattatagacaccatcgtgttagagtagtcgactgactaatacaaacgtagaacacatacgaaacgaacctagttccnccctgacagtctacgtacctcgtgtacgaccgtcccggaggacgtacggggtntagtacttacgtcggtacggaagtaccggacccctaagtacggactacgtccggaaccctaccgttcgttactcgttacggtcgtactttaacgg

SEQ ID NO: 430746 - DNA, 559 bp, Homo sapiens
  misc_feature: GZ8MTXP02FINP6.19.71.G05.1.454.CMB.2.raw
  modified_base (240)..(240): a, c, t, g, unknown or other
  modified_base (320)..(320): a, c, t, g, unknown or other
  modified_base (352)..(352): a, c, t, g, unknown or other
  modified_base (398)..(398): a, c, t, g, unknown or other
  modified_base (404)..(404): a, c, t, g, unknown or other
  modified_base (431)..(431): a, c, t, g, unknown or other
  modified_base (555)..(555): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatacaactgcaagtccagccacaattctttanacagttaccaaacaatagaaaactcttagcttaggaccagcagacgaccaggacacgcctcgtaggctgctctatttacnggcactccgacccgggacgtccggggtccccngaccgattcaggtcggctggcgggtctgggacagtactttcactcncaaccntcagcacgcctgcgaggctagaaagtntggtacgtagttagttttattatacgtaactaaataattaattattattacgttcggtacggtacgtacggaaccgaaagggtacgtaaggtacgatacgaacgaacgtacgtacgtgtcgacncgac

SEQ ID NO: 430747 - DNA, 696 bp, Homo sapiens
  misc_feature: GZ8MTXP02HG36H.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgcctcacctgtcgccagtccgtccggggacaggacgtcgctaggcgacgtagtgttcgcgttggcgtacgtgggtcgacggccacgtaccccagtccggaggtacggtcgtaggaggtggacgtaggggaagtactattacgtttacacgttacgtacctaaacgtacggtagtaaactaacgtaaattacgtacgacctacctagttcgtgttagaagtacgtacgaactacgaactaacgtacgtaaacgtacgaaacacgtaacgaaccgtaaacgaacccgttacgttaccctacccgttacgaccgtaacgtccgtacgtaacccgtttcgtacgggttaccgtaccccgtaacccggggaaacggtaccgggttaaccgggtttagtttaaaccgtttaacggtttaacgggtacgggttaaacgggaaaccggtaaccccgggtaccccctaaaggtaacccg

SEQ ID NO: 430748 - DNA, 610 bp, Homo sapiens
  misc_feature: GZ8MTXP02IWSH0.19.71.G05.1.454.CMB.2.raw
  modified_base (230)..(230): a, c, t, g, unknown or other
  modified_base (242)..(242): a, c, t, g, unknown or other
  modified_base (254)..(254): a, c, t, g, unknown or other
  modified_base (270)..(270): a, c, t, g, unknown or other
  modified_base (306)..(306): a, c, t, g, unknown or other
  modified_base (435)..(435): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacgaactgacaagtccagccanaattcttttaanacacgtaccaanaataataaactactancttagacagcagacgacgagacacgcctcgtagctnctctattacgcggctacgtacccggtaaccgggtacgtcccggggtcctacgaccgtattcgaggtcgaccgacgggtccggggttcgtacgggactagttacttcactcctacacctactacacgacncgcgcgacgacgacgtagagtagtggtgtacgttagtttagttagttacgtaactaactaattaatttaattagttacgttacgtacggtacgttacggtacggtaacggtaacggtaacggtacgtacgtacgtacgtaacgtaacgtacgtacgtacgtacgtacgacgtacg

SEQ ID NO: 430749 - DNA, 625 bp, Homo sapiens
  misc_feature: GZ8MTXP02GG24R.19.71.G05.1.454.CMB.2.raw
  modified_base (238)..(238): a, c, t, g, unknown or other
  modified_base (246)..(246): a, c, t, g, unknown or other
  modified_base (250)..(250): a, c, t, g, unknown or other
  modified_base (256)..(256): a, c, t, g, unknown or other
  modified_base (259)..(259): a, c, t, g, unknown or other
  modified_base (271)..(271): a, c, t, g, unknown or other
  modified_base (302)..(302): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgacgtgacaagtccagcacaatctttanacatcaanatanaaactntanctgacagcaganacagacagcctcgagctgctactatttacgnggacactccgaaccgggacgtcccggggtcccctacgaccgtattcgaggtcggacgcgggtccgggtacgtacggggaacctagttactttccacttccgtaccaaccctagtacgacgacgacgccgtacgacgacggacgtagaagtagtggtaggtacgttagtttagtttagttacgttacgtaaacttaaattaatttaatttaacttacgtttacggttacggttacggttaccggtaaccgtaaacggtaacggtaacggtacggtaacgtaagtaacgtaacgtaacgtacgtacggtacggtacgtacgtacg

SEQ ID NO: 430750 - DNA, 648 bp, Homo sapiens
  misc_feature: GZ8MTXP02GLGOX.19.71.G05.1.454.CMB.2.raw
  modified_base (312)..(312): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgcccagtcgtcccggggacagagtcgctagcgacagtgttgcttggcacgtggtcaggcacgtccccatcgagnggtctagagtggcgtaggggaagactattactttcattcgtcccaaacgacggtaggaaattaacaaaatttagtagaccaccgtaattcgttaggttacggaaggtacgtaccgtacgtagaaactaaagtaacgaaacggttaacgaaaccaactaacgtaccgaaaacgtaaacccgtaacgtttaccctacccgttacgactacggtccttacgacccttcttcggtaccgtacccgtacccgggaacggtaccggtaccggggttagttaacgttaagtttaaccggtaggttacgggtaaacggacccggtacccccgtaagttaaccgg

SEQ ID NO: 430751 - DNA, 538 bp, Homo sapiens
  misc_feature: GZ8MTXP02GB1F8.19.71.G05.1.454.CMB.2.raw
  modified_base (244)..(244): a, c, t, g, unknown or other
  modified_base (258)..(258): a, c, t, g, unknown or other
  modified_base (325)..(325): a, c, t, g, unknown or other
  modified_base (379)..(379): a, c, t, g, unknown or other
  modified_base (406)..(406): a, c, t, g, unknown or other
  modified_base (411)..(411): a, c, t, g, unknown or other
  modified_base (415)..(415): a, c, t, g, unknown or other
  modified_base (424)..(424): a, c, t, g, unknown or other
  modified_base (432)..(432): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacaactgacaagtccagccactaattctttanacagttacccaaanaatgaaaactctagcttggaccagcagagaccaggactagcctaccgtaggctgcttctatttacgngggactatccgtaccggggaagtcccggggtcccctgacccgtattcgagtgcngggcggtctggggacagtattcactcncaccntcancagccagcnggactganatggtgctagtttatatcgataaatataattatattacgttcggtaggtacgttcggacctaagggaccaggtacgataccaagagacgtactggtacgcgtcacc

SEQ ID NO: 430752 - DNA, 572 bp, Homo sapiens
  misc_feature: GZ8MTXP02FTCFF.19.71.G05.1.454.CMB.2.raw
  modified_base (348)..(348): a, c, t, g, unknown or other
  modified_base (475)..(475): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtggtcaggcagtccccatcgagagtctagagtggcgtagggaagcagtatttcaagttgtaccaatacggtggaaactacaaaatttnagacacctatctagttgagagtcgatgaacaatcaaacgtagaacacatacgaacgtaaccagtttccaccgtgactacgctacgaccttctacggtacgaccctccggaaggaccgtaacggggtntaacttagttacgtaggtacggaaacgaccggaccccaagttaccgaaacctacgtaccgaacccgtacgttcgtcgtcgtacgtacgtacttaacg

SEQ ID NO: 430753 - DNA, 652 bp, Homo sapiens
  misc_feature: GZ8MTXP02IBVX4.19.71.G05.1.454.CMB.2.raw
  modified_base (578)..(578): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccagtcgtccggggacagagtcgctagcgacagtgttgcttggcacgtggtcaggcagtccccagtcgagtaggtctagagtggcgtggggaaaggacctagttactttcaacgttcggtaccaaacgtacggtacgggtaaaactaaccgtaaaatttactacgacctacagttcgtagttagagtacgtcgaactagaactaagtacgaaaacgttagaaaccaacgtaacgtacgaaaacggaaccctaagttcctacccgtaggacacggtacctacgcccttacgtcggttaccgaaccgttacccccggaaaggtaacccggttaaccgggggttntttaaaacgttaacgtttaaccgtacgggttagggaaaaccggttaccgggaccccctaaagggtttaaacccg

SEQ ID NO: 430754 - DNA, 576 bp, Homo sapiens
  misc_feature: GZ8MTXP02GMXER.19.71.G05.1.454.CMB.2.raw
  modified_base (238)..(238): a, c, t, g, unknown or other
  modified_base (290)..(290): a, c, t, g, unknown or other
  modified_base (312)..(312): a, c, t, g, unknown or other
  modified_base (358)..(358): a, c, t, g, unknown or other
  modified_base (410)..(410): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacngcctcaggctgctcatttacgngggcatccgtaccgggaatccgggtcccctgaccgatcgagtggcnggtcggtcgtggacagtatttccgacttcctacacccatcagcacggtcccngacgacgtacgtagtaagtgtgtacgtacttagtttattagtacgtaactaaataatttaattattacgttacgttacgtacggtaccgttacggaaccgtaaacggtacgtaagggtacgtagtaacgtaacgaacgtaacgtacgtggtacggtacgtacgacg

SEQ ID NO: 430755 - DNA, 631 bp, Homo sapiens
  misc_feature: GZ8MTXP02HS0JS.19.71.G05.1.454.CMB.2.raw
  modified_base (307)..(307): a, c, t, g, unknown or other
  modified_base (384)..(384): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcggcacgaccctctcgctcacctgtgccatcgtccggggacagagtcgctagcgacagtgttgcttggcacgtgggtcaggcacgtcccatcggagngtctaggagtggcgtaggggaacgactagttacttcagtcgtaccacgtacggttaggaaactaactaaaatttacngaccacctattcgtagttagaacggtagttacggaccttagaaactaaactacgtaaacgtaacgacaaactaacgttaacggaaactaaacccgtacgttacccgtaccccttaggtacaacgggtccttacgaaccctttcgtacgttacgacccgttacccggaaggtaccgtaccggggtacgttaattacgtttaaccgtaggtacggtaaacggtaccggtaacccccaagtacgtaaacg

SEQ ID NO: 430756 - DNA, 714 bp, Homo sapiens
  misc_feature: GZ8MTXP02F42T8.19.71.G05.1.454.CMB.2.raw
  modified_base (240)..(240): a, c, t, g, unknown or other
  modified_base (254)..(254): a, c, t, g, unknown or other
  modified_base (335)..(335): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccaacaattcttttaanactacgttaccaanaataacgtaaaacttacttagcttacggaccagacaagacgaccgaaggacacgccctacgagctgacctactatttacgngggacctacgttacccggtaacccggggtaacgtccccggggtcctacgtacccgtattacgaggtcggacgacgggtcggggtcagggaactagttactttacgacttccctaccaacctagtaccacgacctacgtccgtacgacgacggtacgtaagaagtagttggtacggtactttaagttttaatttaacgtttaacgtaaacctaaaattaaatttaaattttaagttaacgttaacggtttacgggtaacggttaacccggttacgggaaacccggtaaacggggtaaaccgtaaagggttacgtaaacgtacgtaaccgtaaaggtaaaccgtaacggttacggtacggtaccgtaccggaacctaaccg

SEQ ID NO: 430757 - DNA, 563 bp, Homo sapiens
  misc_feature: GZ8MTXP02JACX6.19.71.G05.1.454.CMB.2.raw
  modified_base (385)..(385): a, c, t, g, unknown or other
  modified_base (420)..(420): a, c, t, g, unknown or other
  modified_base (429)..(429): a, c, t, g, unknown or other
  modified_base (456)..(456): a, c, t, g, unknown or other
  modified_base (461)..(461): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtccttcacaagtacagctgcagcagtcaggtccaggactggtgaacgccctcgcacgaccctctcgctcacctgtcgccatcgtccggggacagagcgctagcgacagtgttgcgttggctacgtgggtcacggcacgtccccagtcggagaggtcgtaggagtggacgtaggggaacgactagttattcagtacgtaccacgacgtaggaaataacaaattancgacactatcgtgtagagagtacgatagaactaanacaacgtanaacacagtacgaacgtaactagtaccnccgtncagcctacgcctcgtacgacgaccgtacccggaaggtaccgtacgggttatacgttaagttaacgacggtacggaaacgacccggtacccaaggtacgaacg

SEQ ID NO: 430758 - DNA, 629 bp, Homo sapiens
  misc_feature: GZ8MTXP02J0IJG.19.71.G05.1.454.CMB.2.raw
  modified_base (250)..(250): a, c, t, g, unknown or other
  modified_base (346)..(346): a, c, t, g, unknown or other
  modified_base (391)..(391): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgaggccggccaccatcaactgacaacgtccacgaccaactaacttcttttaanactacgttaccaaacaataacgtaaaacttcttagcttacggaaccagacaagacgaccgaggacacgccctacgtaggctgcctactacttacgnggactacgtaccgtacccgggacgtcccggggtcctacggacctntcgaggtcggacgacgggtcgggtcgtaggactagtacttcctactcaccacgtctcgacgcgacgtccgtgaccgagcgtagaagtcgttggtacgtagttagttttatacgttacgtaaacctaacttaatttaacgtttactacgttacgtacgggtacgtaccgggttacggacggtaacggaacgtaggagtaactacgacgaagtacgtacgtggacgtacgtacactaccg

SEQ ID NO: 430759 - DNA, 628 bp, Homo sapiens
  misc_feature: GZ8MTXP02IYS0W.19.71.G05.1.454.CMB.2.raw
  modified_base (399)..(399): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccagtccgtccggggacaggacgtcgcgtagcgacgtagtgttgcgttggcacgtggtcacggccacgtccccagtacggaggtaggtacgtaggagtcggacgtaggggaagactattatttacattcgaccaaacgtacgtagaaactactaaattntacgactactattcgtaggtagaagtacgtccgaatacgaaacaacgtacgaaacgtacaacaacgtagtaaccgaaacgtaacccttacgttcctaccgtgaactcgtacctacgtaccccgttagtcggtaccgacccggttacccgggaaaggtaccgttaacgggttacttaagttaacgtttaacggtaggtaaacggaaccgaccggtacccctaagtaaccg

SEQ ID NO: 430760 - DNA, 617 bp, Homo sapiens
  misc_feature: GZ8MTXP02J2A6Z.19.71.G05.1.454.CMB.2.raw
  modified_base (243)..(243): a, c, t, g, unknown or other
  modified_base (323)..(323): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccgatacaactgacaagtccagccacaattcttttanacagttccaaacaatagaaaactacttagcttaggtaccagcagagaccaggacagccctcgtaggctgctcatttacgnggcactaccgtaccgggacgtcccggggtcccctagaccgtacttcgaggtcggacgcgggtccggggttcgtagggactacgttactttccactcctaccacctactcacgcacgtcctgacgtacggtcgtagaagagtggtgtattagtttattagttactactaaataagttaattaattacgttacgttacggtacggtaccgttacgggaaccgtaaacgggtaccgtaagggtacgtaactacgtaacgaaacggtaacggtacgttacggtacggtacgtacgacg

SEQ ID NO: 430761 - DNA, 556 bp, Homo sapiens
  misc_feature: GZ8MTXP02GZ9W3.19.71.G05.1.454.CMB.2.raw
  modified_base (242)..(242): a, c, t, g, unknown or other
  modified_base (323)..(323): a, c, t, g, unknown or other
  modified_base (374)..(374): a, c, t, g, unknown or other
  modified_base (412)..(412): a, c, t, g, unknown or other
  modified_base (423)..(423): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacgggacatcgtgatgacccagtctccagactccctggctgtgtctcgtgggcgagcgggccaccgatacaactgacaagtccagccactaattctttanacagttaccaactaatagaaaactacttagcttaggtaccagcagacgaccaggacagcctcgtaggctgctctatttacnggcattccgtacccgggattcccggggtcccctgaccgtattacagtcgcnggcgggtacgtggggacagtacttcactcctcacctancgagcacgccngacgagagtagatgtgagtattagtttatatgactaaatattattattacgtagttcgtacggttacgttacggaacgtaaaggtactagggtacattacgaacgtaacgacgtacgtagtcgtactacgacc

SEQ ID NO: 430762 - DNA, 550 bp, Homo sapiens
  misc_feature: GZ8MTXP02FNTV0.19.71.G05.1.454.CMB.2.raw
  modified_base (241)..(241): a, c, t, g, unknown or other
  modified_base (317)..(317): a, c, t, g, unknown or other
  modified_base (444)..(444): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacaactgacaagtccagccacaattctttanacagttccaactaatagaaaactcttagcttggaccagcagagaccaggacagcctctaggctgctctatttacgngggcagtccgtaacccggggaattcccggggtaccccctggacccgtattccgaggtcggcagggccgggtctaggggacctagtactttcactctacaccatccagcagcctgcaggctagaaagntgtggacttagtttattatcgtacaaatattaattatatacttcggtagtacgttcgaccgaaagggaccaaggtgattagaacgagtacgaagtgtacgctgacc

SEQ ID NO: 430763 - DNA, 558 bp, Homo sapiens
  misc_feature: GZ8MTXP02IY35L.19.71.G05.1.454.CMB.2.raw
  modified_base (371)..(371): a, c, t, g, unknown or other
  modified_base (373)..(373): a, c, t, g, unknown or other
  modified_base (386)..(386): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgtgcttggcacgtgggtcaggcacgtccccatcgagagtctagagtggctaggggaagacagtatttcattgtaccaaacgacgtagaaatacaaattananaccacatctgttnagatcgatgaacaatcaaagtacgaacactaagtacgaaagaaccctagttacctcccgtgacctagacctacgaccctcgtacgttacgaaccgttaccggaacggtaccgtacgggttacgtaagttaacgttacgtacggtaggaacggaccgtaccccgtaagtaacg

SEQ ID NO: 430764 - DNA, 607 bp, Homo sapiens
  misc_feature: GZ8MTXP02JJSEK.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacaggagtcgctaggcgacagtgttgcttggcacgtgggtcaggcacgtccccagtcgagaggtctaggagtggctaggggaaggactagttatttcattcgtaccaacgacggtaggaaactacaaaattatgacaccatctgttgagtagtcgactagaactaaatcaaacgtagaacacaagtacgaaacgtaacctacgttcctaccctgaccgagtcctacggtacccttcgtacgttacgaccgtcccggaagggtaccgtacgggttagtattaacgttactagggttacggaaacgacccggacccctaagtacggaacctacgaccgcctaacccgttcggttcctcgtttcggggtactaccgtttaaacgg

SEQ ID NO: 430765 - DNA, 712 bp, Homo sapiens
  misc_feature: GZ8MTXP02G35TD.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagacgtcgctagcgacagtgtgcttggcacgtgggtcaggcacgtccccatcgagaggtctaggaggtggcgtaggggaaggactattatttcattcgtaccaaacgtacggtaggaaattaacgtaaaatttactacgacctaacctattacgttaggtttacggaaggttacggttaccggaacgttaggaaacctaaagtaccgtaaaaacggttacgaaaacccaaacgtaaacgttaacccgggaaaacgtaaaaccccgttacggtttaccccttaccccgttaggaccctaacggtacccgttacggtaacccctttcgttacggtccggtaaaccccggttacccggaaacggggtacccgttaacggggttagtttaaacgttaacgtttaaccggttaggggttaacgggtaaaccgggaccccggtacccccgtaaagttaacccgg

SEQ ID NO: 430766 - DNA, 554 bp, Homo sapiens
  misc_feature: GZ8MTXP02FLA3D.19.71.G05.1.454.CMB.2.raw
  modified_base (221)..(221): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctntcgctcacctgtgccatcgtccggggacagagtcgctagcgacagtgtgcttggcacgtgggcaggcacgtccccatcgagaggtctaggagtggctaggggaacgactagtatttcagttcgtacccaacgacggtaggaaatactaaaatttatagccaaccattcgttagttagaagagtacgactgacaatacaaacgtagacacatacgaagaaccagttcctccgtgacagctacgacctcgtcgtacgaccgtacccggaggtacgacggggttataagttacgtaacgtaggtacggaaacgtaccggacccctaagtacgaacg

SEQ ID NO: 430767 - DNA, 715 bp, Homo sapiens
  misc_feature: GZ8MTXP02IM8W4.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctccgctcacctgtcgccactccgtccggggacagacgtcgctacgcgactagttgttcgtcgtttggctacgttgggtcgaggccacgtccccagtcgaggtacggtcgtaggtaggtggacggtaggggaaacggtactagttatttcgaacttcgtacccaaacgtacggtaggtaaactaaactaaattatcgacctaactagttcttggttagagtacgtacgaacttagaactaaagtacaaacgtagaaaccactagtaacgaaacgtaaaccctacgtttaccctcccctaggcccgtaaacgtcccgtttaccggaacccctttcggttaccggttaccggtaaacccccttacccggggaaacgggttaaccccgggtaaccgggggttttaattaaacgtttaaaccgttttaaccgggtacggttaaaccgggggaaaaccgggttacccccggaaaacccccgtaagtttaaacccgg

SEQ ID NO: 430768 - DNA, 585 bp, Homo sapiens
  misc_feature: GZ8MTXP02FSF1V.19.71.G05.1.454.CMB.2.raw
  modified_base (269)..(269): a, c, t, g, unknown or other
  modified_base (309)..(309): a, c, t, g, unknown or other
  modified_base (316)..(316): a, c, t, g, unknown or other
  modified_base (370)..(370): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtgccatcgtccggggacagagtcgctagcgacngtgtgcttggcacgtgggtcaggcacgtccccagtcgagngtctagngtggcgtggggaagacatattcatcgtaccagacgtaggaaataactaaattangacaactatctagtagagtagtcgaactagaactaatacaaagtaacgaacaacaacgtaacgaaacgtaaacctagttacccctccgtagacctacgtacctacgtaccctcgtacggtacgtaacccgtacccgggaaaggaccgtacggggttagtaactttacgttaacggtaggtaacgggaaacgacccggaccctaagtaacgaaccg

SEQ ID NO: 430769 - DNA, 737 bp, Homo sapiens
  misc_feature: GZ8MTXP02JQ2BQ.19.71.G05.1.454.CMB.2.raw
  modified_base (244)..(244): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgacaagtccagccaactaattctttaanactacgttaccaactaataacgaaacttacttagtcgttacgacagacaagacgaccgaggacacgtcctacgtaggctacgctactatttacgcggactacgtaccgtacccgggtacgtccgggtacccctgaccgtacttcgaggtcggcgcgggtccgggtcgtacgggactagttactttaccaccttcctacctaacctacgtacgacgacgaccgtccgtacggtaccgtacggtaccgtaaggaaacggtagttacgggtacggtacgtttaacggtttttaacgtttaacgtttacgttaaacctaaaacgtttaaactttaacgtttaaacgtttaacgtttacgtttacggttacgggttaaccgggtttaccgggtaaaccgggtaaaacggggtaaaccggttaaacgggttaacggtaacgttaaacgtaacggaaacggtaaaccggtaacggttcggtaccggtaccgtacgaaccg

SEQ ID NO: 430770 - DNA, 625 bp, Homo sapiens
  misc_feature: GZ8MTXP02JON2X.19.71.G05.1.454.CMB.2.raw
  modified_base (241)..(241): a, c, t, g, unknown or other
  modified_base (321)..(321): a, c, t, g, unknown or other
  modified_base (384)..(384): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccacaattcttttanacagttaccaaacaatacgaaaactactagcttaggtaccagcagagaccaggacagcctcgtaggctgctcatttacgngggcacgtaccgtaacccggggaagtcccggggtaccccctgacccgtattccgaggtcggcngggtccgggtcgtaggggacctaggtactttccactcctcacccatcagcacgcctgccagggctaggaaagtgttaggtggtacttaaggttttattaagttacgtaacctaaaacttaatttatttaatttacttacgttcggtacggtacggttaccgggaccgtaaaaggggaccgtaagggtaggtaacttaagtcggaaacgtaacggtaacgttggtacggtaccgtgtaaccc

SEQ ID NO: 430771 - DNA, 599 bp, Homo sapiens
  misc_feature: GZ8MTXP02I4US0.19.71.G05.1.454.CMB.2.raw
  modified_base (237)..(237): a, c, t, g, unknown or other
  modified_base (246)..(246): a, c, t, g, unknown or other
  modified_base (250)..(250): a, c, t, g, unknown or other
  modified_base (258)..(258): a, c, t, g, unknown or other
  modified_base (265)..(266): a, c, t, g, unknown or other
  modified_base (303)..(303): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactctctggctgtgtctctgggcgagcgggccacgatcgaactgcaagtccagccacaatctttanacatacaanatanaactctanctgacannagacgacagacagcctacgagctgctactatttacgnggactacgtccgtaaccggggacgtcccccggggtaccctcgaccgtattacgaggtcggacgtacgggtccggggtacgtacgggactagttactttccaccttcctccaaccatcgagacacgcgtcgacgacgtacgtagaagtagtgtgtacgtagtttagttagttacgtactaactaaattaatttaattacttacgttacggttacggttacggttacggtacggtaacggtaacgtaacggtaggtagtaacgtacgtaacgtaacgtaacgtacgtacgtacgtacg

SEQ ID NO: 430772 - DNA, 512 bp, Homo sapiens
  misc_feature: GZ8MTXP02IF3RH.19.71.G05.1.454.CMB.2.raw
  modified_base (240)..(240): a, c, t, g, unknown or other
  modified_base (252)..(252): a, c, t, g, unknown or other
  modified_base (314)..(314): a, c, t, g, unknown or other
  modified_base (363)..(363): a, c, t, g, unknown or other
  modified_base (423)..(423): a, c, t, g, unknown or other
  modified_base (426)..(426): a, c, t, g, unknown or other
  modified_base (446)..(446): a, c, t, g, unknown or other
  modified_base (507)..(507): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccgatcaactgcaagtccagccacaatcttttanacagttccaaanaatgaaaactacttagcttggtacagcagagaccaggacagcctctaggctgctcatttacnggcatccgtacccgggaatcccggggtcccctgaccgattcagtcggcngggcgggtctggggactaggtatttcgactctcacccatcagcagcctgcaggctgaaantgngtctagtttatatgacaaanattattattatctgtggtactcggcctaaagggccaaggtagatactgagacgactggtcnctgac

SEQ ID NO: 430773 - DNA, 573 bp, Homo sapiens
  misc_feature: GZ8MTXP02JSRY4.19.71.G05.1.454.CMB.2.raw
  modified_base (237)..(237): a, c, t, g, unknown or other
  modified_base (249)..(249): a, c, t, g, unknown or other
  modified_base (315)..(315): a, c, t, g, unknown or other
  modified_base (352)..(352): a, c, t, g, unknown or other
  modified_base (364)..(364): a, c, t, g, unknown or other
  modified_base (399)..(399): a, c, t, g, unknown or other
  modified_base (571)..(571): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctggtcgagcgggccacatcaactgacaagtccagccacaatctttanacagttccaaanaatagaaactactagcttaggaccagcagacgaccaggacagcctccgtaggctgctcatttacgnggcatccgtacccgggatcccgggtcccctagaccgnttcgagtcggcnggtccgggtctagggactagtactttcgacttccncacctatccgaagccagtccctagacagggctaggaaatgttgacggtcttaagttttatattagacctaaaattattatttaacttagtaccgttaggtacggtaacggttccggaaccggtaaaggggtacctagggtcgtaattagcgaagactacggtgtacggctanac

SEQ ID NO: 430774 - DNA, 627 bp, Homo sapiens
  misc_feature: GZ8MTXP02H16NP.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctccacaaggtgtcctgtcacaagtacagctgcagcagtcaggtccaggactggtgaacgccctcgcacgaccctctcgctcactgtcgccagtcgtccgggacagagtcgctagcgacagtgttgcttggcacgtgggtcaggcaacgtcccagtcgagaggtcagagtggcgtagggaacgactagttattcagttcgaccacgtaacggttagaaacttaacgtaaaatttacgagacctaaccgtattcgttagttacggagaacgttacgacgtagaaactaacgtaccaaaacgtacgaaactactaacgttaccgggaaaactaacccgttacgtttacctacccgtagaccgacgtcctacgtacccgtcgttcggtaaccgtaccgtaccggagggaaccggtacgggttattaaagttacgttaacggtacggtaacggaaacggtaccggtacccctaaaggtacgaaccg

SEQ ID NO: 430775 - DNA, 585 bp, Homo sapiens
  misc_feature: GZ8MTXP02H1VSR.19.71.G05.1.454.CMB.2.raw
  modified_base (243)..(243): a, c, t, g, unknown or other
  modified_base (329)..(329): a, c, t, g, unknown or other
  modified_base (394)..(394): a, c, t, g, unknown or other
  modified_base (433)..(433): a, c, t, g, unknown or other
  modified_base (436)..(436): a, c, t, g, unknown or other
  modified_base (443)..(443): a, c, t, g, unknown or other
  modified_base (449)..(449): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccactaattcttttanacagttacccaacaatacgaaaactacttagtcttacggtaccagacagacgaccaggacacgcctcgtaggctgctctatttacngggacctactccgtaaccccggggattcccggggtccccctggaacccgtattccgagtcggacngggtccgggtctggggactagtctttcactctcacctancancacgccngcgagntagagtgtgtgtattagtttatattagactaaataattatttaattatacgttggtacggtacgttaccggacgtaaacgggtaacgtaggtacgtaatacgtaacgaacgaacgtacgtggtacgtactacgacc

SEQ ID NO: 430776 - DNA, 597 bp, Homo sapiens
  misc_feature: GZ8MTXP02GN5J7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtgggtcaggcacgtccccagtcgagaggtctagagtggcgtaggggaagactatatttcattcgtccaaacgacggtaggaaataactaaaatttatcgacaacctatctaggttagaagtagtacgactagaacaaatcaaacgtagaaccactaagtacgaaacggaacctacgttcctaccctaggaccaagtccgtacgaaccccttgtacgttaccgacccgttacccggaacggtaccgtacggggttattaacgttaagtttacgtagggttacggaaacggacccggtaccccctaaggtaaccg

SEQ ID NO: 430777 - DNA, 557 bp, Homo sapiens
  misc_feature: GZ8MTXP02JYF0H.19.71.G05.1.454.CMB.2.raw
  modified_base (394)..(394): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcagtccccatcgagaggtctagagtggctaggggaaggactatatttcatgtaccaacacggtaggaactacaaatttagcgacacctatcttagttgaagtagtcgactagacaatacaaacgtanacacatacgaagaacagttcctacctgacacgctcgacctcgtgtcgaccgtaccgaggacgtacgggtgtatatacgtaggtacggaacgacggtacccccgagtaacgacgtacgtaccgaacccgtaccgttccggtctcgttcggtcgtacctttacgg

SEQ ID NO: 430778 - DNA, 594 bp, Homo sapiens
  misc_feature: GZ8MTXP02HS9F5.19.71.G05.1.454.CMB.2.raw
  modified_base (207)..(207): a, c, t, g, unknown or other
  modified_base (245)..(245): a, c, t, g, unknown or other
  modified_base (329)..(329): a, c, t, g, unknown or other
  modified_base (391)..(391): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccncgatcgaactgacaagtccagccactaattcttttaanacacgttacccaaataatacgaaaactacttagcttggtaccagcagacgaccaggacagcctcctaggctgctatatttacgngggctagtccgtaaccccggggaagtccccggggtcccctacgacccgtattccgagtcggnacggggtcgggtctaggggacctagtactttcactctacaccatcagcacgcctgccaggcagaaagagttggtaggtataggttttatatagtacaaataattattaagtttactacgttgtacgtacggttacggaccgtaaaagggacctaagggtacgaatagtcgaaacgtacgtaacgtggtaccgtagtcgtaacc

SEQ ID NO: 430779 - DNA, 561 bp, Homo sapiens
  misc_feature: GZ8MTXP02JKUIE.19.71.G05.1.454.CMB.2.raw
  modified_base (372)..(372): a, c, t, g, unknown or other
  modified_base (431)..(431): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaattcttttatactagtttcaacaatagaaaactactagcttggtaccagcagagaccaggacagcctctaggctgctcatttacgtgggcatccgtaaccccggggaatcccgggggtccccctgaccgtattcgagtggcnggccgggtctggggacagtactttcacttctcaccatcagcagcctgacaggctgaaanatgtggtactagtttattattgtacaactaattattattatacttcgtacggtacgttcggacgtaaacgggacgtaacgggtaggtaatagtaacgaggtaacgtaacgtgtacggtcctaggaacccg

SEQ ID NO: 430780 - DNA, 699 bp, Homo sapiens
  misc_feature: GZ8MTXP02JTFB4.19.71.G05.1.454.CMB.2.raw
  modified_base (232)..(232): a, c, t, g, unknown or other
  modified_base (241)..(241): a, c, t, g, unknown or other
  modified_base (325)..(325): a, c, t, g, unknown or other
  modified_base (515)..(515): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatccaactgcaagtccagccaanatcttttanactagttaccaaacaatagaaaactacttagcttaggaccagcagagaccaggacacgcctacctaggctgctactatttacgnggactacgtaccgtaaccccggggaacgtccccggggtaccccctaggacccgtacgttcccgaagggttcggaccgacggggtccggggtcttacgggggaacctaggttactttccaccctttactaccaaccccgtatacccgaagccgtaaccgtccgtacggaccgtagggactagggaaaacgngttacggtcggtattaaggttttattaacgtttcgaacctaaaataatttaatttaagttaattacccgttaggttacgggtaccggtttaccgggaacgtaaaaccggggtaaccgtaaacggggtagtaactaacgtaaccgaaaggtaaaccggtacgtaggtccggtaagtccggaaccc

SEQ ID NO: 430781 - DNA, 668 bp, Homo sapiens
  misc_feature: GZ8MTXP02H2PXA.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatccgtccggggacagagtcgctacgcgacagtgttgcgttggctacgtgggtcaggcacgtcccagtcgagaggtcgtagagtggcgtagggaagactattactttctaagtcgtacccaaacgtacgtaggtaaaacttaaacctaaaagttacgttacggaaccctaacctagtttccgtaggtttaggaacgttaggttaccgaacttaaggaaacctaaattaccgaaacgtaacgaacaaacgtaagtaaccgaaaacgtacccgtaagttcccgtaccgttagacctaagccctacggaacccttcggtacgttacccggaacccgtccccgggaaaggtacccgtacggggtttactaaacgtttaacgtttacggacgggttaaacgggtaacgaccccgggtacccctaaagtaaccg

SEQ ID NO: 430782 - DNA, 568 bp, Homo sapiens
  misc_feature: GZ8MTXP02JUVW0.19.71.G05.1.454.CMB.2.raw
  modified_base (240)..(240): a, c, t, g, unknown or other
  modified_base (319)..(319): a, c, t, g, unknown or other
  modified_base (375)..(375): a, c, t, g, unknown or other
  modified_base (385)..(385): a, c, t, g, unknown or other
  modified_base (413)..(413): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattcttttanacagttaccaacaatagaaaactacttagcttggtaccagcagacgaccaggacacgcctctaggctgctcatttacgngggcatccgtaccccggggatcccggggtccccctggaccgtattcgaggtcggcngggtcgggtntacggggacagtatttcactctcaaccntacagcacgtccctgcgagggctaggaacgagtggtaggcttagtttattattgtactaaactattatttatacttacgttcgtacggtacggttcgacgtaaagggtacctaaggggtgtaatagtaacgaagacgtaagtgacggtctagacc

SEQ ID NO: 430783 - DNA, 710 bp, Homo sapiens
  misc_feature: GZ8MTXP02G06C6.19.71.G05.1.454.CMB.2.raw
  modified_base (245)..(245): a, c, t, g, unknown or other
  modified_base (290)..(290): a, c, t, g, unknown or other
  modified_base (311)..(311): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacngtgtgctggcagtggcaggcacgtccccatccgagaggtctaggngtggcgtgggaaggactattntttacatcgtaccaagtacggtaggaaactaactaaattacgtcgacctaaccgtaattcgtagtttaggaacgtacgttccgtaacgtacgaaacctaaacgttaaccgaaaaccggtttaaacgaaacctaaaccgtaaacgttaaaccggaaaacccggtaaaaccttaacgggtttaccctaccccgttagaacctacggttaccctacggtaacccttcggttacggtaccgtaacccgttaccccgggaagggtaacccggtacgggttattaacgtttaaacgttacggtaggtacgggaaacgttccccgggaacccctaaaggttaccgaacgtacgttacccgaaccgttacccgtcgttccgtacgttcggtacgtacgttttaacgg

SEQ ID NO: 430784 - DNA, 545 bp, Homo sapiens
  misc_feature: GZ8MTXP02GE9UP.19.71.G05.1.454.CMB.2.raw
  modified_base (245)..(245): a, c, t, g, unknown or other
  modified_base (326)..(326): a, c, t, g, unknown or other
  modified_base (379)..(379): a, c, t, g, unknown or other
  modified_base (437)..(437): a, c, t, g, unknown or other
  modified_base (446)..(446): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggcgggccaccatcaactgacaagtccagcccaacaattctttanacagttaccaaacaatagaaaactacttagcttaggtaccagcaagacgaccaggacagcctctaggctgctctatttacnggctactccgtaccggaagtcccggggtaccccctgacctattcaggtcggcnggcgggtctaggggacagtacttcactctccacatcagcacgcctgcagctagaaagntggtcggtntaagttttatagtatacaataaattattattatattcgtagtacgttcgaccgaaaggacgaaggtagaactataacgaagacgaatggtcgactagac

SEQ ID NO: 430785 - DNA, 622 bp, Homo sapiens
  misc_feature: GZ8MTXP02GE5E2.19.71.G05.1.454.CMB.2.raw
  modified_base (242)..(242): a, c, t, g, unknown or other
  modified_base (321)..(321): a, c, t, g, unknown or other
  modified_base (376)..(376): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaagtccagccacaatcttttanacagttccaacaatagaaaactcttagcttggtaccagcagagaccaggacagtcctcctaggcctgctacatttacgnggcatccgtaccggaacgtccggggtcccctagaccgtattacgaggtcggacgngggtcgggtcgtagggactagtactttccacttcctaccaacctactacgaacgcacgccctacgcgacgacgtagaagtagtggtggtacgttagtttagttagttagtactaaactaaattaatttaattaacttacgttacgttacggtacggttacggtaccggtaaacggtaaacggtaacggtaacggtaagtaacgtaacgtaacgtaacgtaacgtacggtacggtacgtacgtaccg

SEQ ID NO: 430786 - DNA, 577 bp, Homo sapiens
  misc_feature: GZ8MTXP02HDE6S.19.71.G05.1.454.CMB.2.raw
  modified_base (230)..(230): a, c, t, g, unknown or other
  modified_base (241)..(241): a, c, t, g, unknown or other
  modified_base (252)..(252): a, c, t, g, unknown or other
  modified_base (257)..(257): a, c, t, g, unknown or other
  modified_base (570)..(577): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccgatacgaactgacaagtccagccanaattctttaanactactacaanaatanaaactactagctagacagacagacgacgagacacgcctacgtagctcgtctactacgttacgcggacctacgtacccggtaacccggggtacgtccccggggtacctaccgtaaccgttacgttacgacggtcggaccggtacggggtccggggttaccggtaggggaaacctaggttacctttaccgaccctttaccgtaccctaaacctacgtaccgacggtaccgtaaccgtcccgtaaccgtaccggtaacgggtaacggtaacggtaaacggtaacggttacgggtttacgggttaacggttttaaannnnnnnn

SEQ ID NO: 430787 - DNA, 572 bp, Homo sapiens
  misc_feature: GZ8MTXP02HXQU4.19.71.G05.1.454.CMB.2.raw
  modified_base (242)..(242): a, c, t, g, unknown or other
  modified_base (322)..(322): a, c, t, g, unknown or other
  modified_base (379)..(379): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaagtccagccacaattcttttanacagttaccaaacaatagaaaactacttagcttaggaccagcagacgaccaggacagcctcgaggctgctctatttacgngggcacgtcgtaccccggggaatcccggggtcccctgacccgtattccgagtcggcngggtcggggtctagggacctagtactttcactcactaccatcagcagcctgcaggctagaaagtgtggtggtacttagtttatagttgactaaataattatttaattattacgttacggtaggtacgtttacggaccgaaagggtaccaagggttcgattaacgtcgaagtaaccgaagtgacggtctagacc

SEQ ID NO: 430788 - DNA, 590 bp, Homo sapiens
  misc_feature: GZ8MTXP02GWKH7.19.71.G05.1.454.CMB.2.raw
  modified_base (231)..(231): a, c, t, g, unknown or other
  modified_base (240)..(240): a, c, t, g, unknown or other
  modified_base (244)..(244): a, c, t, g, unknown or other
  modified_base (253)..(253): a, c, t, g, unknown or other
  modified_base (299)..(299): a, c, t, g, unknown or other
  modified_base (401)..(401): a, c, t, g, unknown or other
  modified_base (413)..(413): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacatcaactgcaagtccagccacatctttanacatacaanatanaaactctanctgacagacagacacagacacgcctcgtagctgactactattacgnggactacgtaccgtaaccggacgtcccgggtcctacggacctatcgaggtcggacgagggtccgggtctagggaactagttacttaccacttcctacaccancgaagcacgtcngacgagacagaagtgtggtagtacttaagtttattagtataactaaataatttaattattacgttacgttacggtacggttaccggtacggaaccgtaaacgggtaacgtaagggtacgtaactacgtaacgtaacggtaaacgtaacggttacggtacggtaccgtacgacctacg

SEQ ID NO: 430789 - DNA, 657 bp, Homo sapiens
  misc_feature: GZ8MTXP02GDCN5.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgaccctctcgctcacctgtcgcccagtccgtccggggacaggagtcgctaggcgacgtagtgttgcgttggctacgtgggtcaggcaccgtccccagtcgagaggtctaggagtggcgtaggggaacgtactagttatttcagttcgtacccaaacgtacggttaaggtaaaactaactaaaagtttactacgacctaacctagttacgttgttaggaagtacgtaccgtaacgtagaaactaaataccgtaaaacgtacgaacaacgtagaaccggaaacgtaacccttacgtttaccctacccgtagaccgtaacgtctacgtacccttcgtacggtaccggtaacccggtacccggaaacgggaccggttaaccggggttataaacgttaacgttacggtaggtacgggaaacggaccggtaccccaagtaaccg

SEQ ID NO: 430790 - DNA, 612 bp, Homo sapiens
  misc_feature: GZ8MTXP02G7S01.19.71.G05.1.454.CMB.2.raw
  modified_base (371)..(371): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtcccagtcgagaggtctaggagtggcgtggggaacgactattattcatcgaccagcgtaggaaactaacgtaaattanacgacacctatccgttgttaggaagtagttacggactggaaactaaataccgaaacgttaacgactaaacacgttacgaaacgtaaccctagtttaccctcccgaggactaacggccttacgacccttcgtacggtaccggaacctcccgggtaaaggtaaccgtacgggggttacttaacgtttaaacgttcgttaagggaaccggtaaacgcccggtacccctaagtaacggtaacccg

SEQ ID NO: 430791 - DNA, 576 bp, Homo sapiens
  misc_feature: GZ8MTXP02G6ECT.19.71.G05.1.454.CMB.2.raw
  modified_base (308)..(308): a, c, t, g, unknown or other
  modified_base (314)..(314): a, c, t, g, unknown or other
  modified_base (336)..(336): a, c, t, g, unknown or other
  modified_base (369)..(369): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcacgaccctctcgctcacctgtcgccatcgtccggggacagacgtcgctagcgacagtgtgcttggcacgtggtcaggcacgtccccagtcgagngtcagngtggcgtaggagactatacttnagttcgaccaacacggtagaaatacgtaaattntacgaccacctatctaggttgagtagtcgactagaactataccgaaagtacgaacaacgtagtaacgaaacggtaaaccctagttcccacccgtagacgacgtactacgaccttcgtgtacgacccgtaccggaaacggtaccgtaacgggtattaacgttaacgttacgtaggtaacggtaaccggaccgaccccgtaagtaaccg

SEQ ID NO: 430792 - DNA, 639 bp, Homo sapiens
  misc_feature: GZ8MTXP02F2VX4.19.71.G05.1.454.CMB.2.raw
  modified_base (240)..(240): a, c, t, g, unknown or other
  modified_base (330)..(330): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggccacgatacaactgacaagtccagccataattctttanactagttaccaaactaatagaaaactcttagcttaggaccagacaagagaccaggaccagcctaccgtaggctagcttctaactttacgnggactacgttacgaaccccggggtaaagttcccggggtaccccctagacccgtaattccgaaggtcggacgtacggggcgggttaccgagggggaacctaggttaactttccacttacctacaccctactacacgcgacgccctgcgaggctaggaaagtagtggtagtgttaagttttaagtagttagtactaaataatttattagttactaacgtttcggtacggtacgttaccggacgaaacgggtacctaaggggttacgtagtaacgttaacgaaggtaaccgtacgtcggtagcgtagaaccc

SEQ ID NO: 430793 - DNA, 620 bp, Homo sapiens
  misc_feature: GZ8MTXP02HJ7O7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccatccgtccggggacagagtcgctagcgacagtgttgcttggctacgtggtcaggcacgtccccagtcgagaggtctagaggtggcgtaggggaacgactattatttcgagttcgtacccaaacgtacggtaggaaacttaactaaaattatcgacctacctaagttcgtagttaggaagtacgttacgaacttagaaactaagtacgaaacgtagaacaacgtagtacgaaagtaaaccctacgttacctcccgttagaccacgtcctacgtaacccttcgtcggttacgaaccgttaccccggaaggtaccgtaacggggttattaaacgttaacgttacgtacggtacggaacgacccggacccctaagtaaaccg

SEQ ID NO: 430794 - DNA, 588 bp, Homo sapiens
  misc_feature: GZ8MTXP02H4Y9K.19.71.G05.1.454.CMB.2.raw
  modified_base (156)..(156): a, c, t, g, unknown or other
  modified_base (372)..(372): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccanaaggtgtcctgtcaacaagtacagctgcagcagtcaggtccaggactggtgaagcccctgcagacccctctcgctcacctgtgccactcgtcccggggacagagtcgctagcgacagtgttgcttggcacgtggtcaggcacgtccccatcgagagtctagagtggctagggaagacatatttcattgtccaaacgacgtgaaataacaaatttancgacacatcgtagtagagtagtacgaactagaaactaataacgaaacgtagaaaccaaacgtaaacgtaacgaaacgaaaccgtaacgttaccgtacccgtacgacgacgtaccgtacgtaccgtcgtacgtacgtaccgtacccggaacggacggtacggtagttaagtaacgttaacgtacggtacggtaacggaaccggacccgaacgtaacg

SEQ ID NO: 430795 - DNA, 637 bp, Homo sapiens
  misc_feature: GZ8MTXP02G6UP3.19.71.G05.1.454.CMB.2.raw
  modified_base (465)..(465): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccagtcgtccggggacagacgtcgctagcgacagtgtgcttggcacgtggtcaggccacgtccccatcgagaggtcagaggtggcgtaggggaagactagttactttacagttacgtccgtaaactacggtaaggtaaacttaaaccgtaaaatttacgtacgacctaacctaattcgtaggttagaagtacgttacgaacttagaaactaacgttacaaaacggtanaaactaacgaacgtaacgaaacggtaaaccctacgttccctacccgtagcctaagtccgtacgtaacccttacgtcgttacggacccgtacccggaaggtaccggaacggggttattaaacgtaacgttacgtaaggtaccggaaacgaccccggtacccgtaagtaaccgg

SEQ ID NO: 430796 - DNA, 664 bp, Homo sapiens
  misc_feature: GZ8MTXP02H9OO1.19.71.G05.1.454.CMB.2.raw
  modified_base (243)..(243): a, c, t, g, unknown or other
  modified_base (333)..(333): a, c, t, g, unknown or other
  modified_base (654)..(654): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatacaactgcaagtccagccactaattcttttanactagttaccaaacaatacgaaaactacttaagcttacggtaaccagaccaaggacgaccaggacacgcctcgagctgctctatttacgnggtacactaccgtaaccccggggagtccggggtccccctagaccgtacttcgaggtcggactacggggtcgggttctacggggacagttactttaccgtactccctcaaccctataccgagcgtacgccgtagacgacgggtactaggaaagtgttgggtacgggttaccttaggttttaatttacttaagtaacctaaattaaatttacgtttaatttaacgtacgtttcgggttaacggtaccggtttaccgggaaaccgtaaacggggtaactaacggggaggttaactaagtaaccgaagtacgtaacgtggtacgngttaacgccg

SEQ ID NO: 430797 - DNA, 626 bp, Homo sapiens
  misc_feature: GZ8MTXP02IZEAE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgactagtgttgcgttggcacgtggtcaggccacgtccccagtcgagtacggtacgtaggacgtggacgtaggggaaacgactatacgtttcagttcgtaccaaacgtacggtaggaaactaactaaaattacgtcgactacgtaatcgtgtagagtacgtcgaactagaacaactacgaaacgtagaacacgtataccgaaagtaaccctacgttacctaccgtgactaagtcctacgaacctttcggtacgttaccggaaacccgttcccggggaaaggtaacccggtacgggttaacgttattaaacgttaccggtagggttaacggaaaccggttaccggaaccccgtaattaaaccgg

SEQ ID NO: 430798 - DNA, 700 bp, Homo sapiens
  misc_feature: GZ8MTXP02G7A3N.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgcccacgtccgtccggggacaggacgtcgcgtagcgacgaggttgttcgcgtttggacctacgttgggtcgacggcctacgtccccgagtaccggaggtacggtcgtaggacggtgggacgtaggggaacgtactagttactttacgattacggtacccaaacgtacggttaaagggaaaacttaaacgtaaaactttagtacggaaccctaaaccctagtttacgtagggttacgaagtacgtaccggaacgttacgaaactaaacgtaacgtaaaccggttaacgaaacgtaaacacgttaaccggaaaacgtaacccgttaacgtttccctacccgtacgaccgagtccgtacgtacccgttacgtacgttacgacccgtaccggaacggtaccgtacggggttattaacgttaacgttacgtacgggtacggaacgacccggtaaccctagtaaaccg

SEQ ID NO: 430799 - DNA, 530 bp, Homo sapiens
  misc_feature: GZ8MTXP02F6KTJ.19.71.G05.1.454.CMB.2.raw
  modified_base (226)..(226): a, c, t, g, unknown or other
  modified_base (235)..(235): a, c, t, g, unknown or other
  modified_base (246)..(246): a, c, t, g, unknown or other
  modified_base (314)..(314): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtggcgagcgggccaccatcaactgcaagtccagccanaatctttanacagttccaanaatagaaaactacttagcttaggtaccagcagacgaccaggacagcctcctaggctgctctatttacngggcagtcctacccgggaatcccggggtcctgaccgattcagtgacagcgggtctggacagattcactctcacatcacacagccctgcgagctagaagagtcgtggacttagtttatagttgtaccaataattattattatacgttcgtagacgttcggacaacggaccaaggtcgtaagatacgaagaccgtaaagtcggtagctacgactaacc

SEQ ID NO: 430800 - DNA, 611 bp, Homo sapiens
  misc_feature: GZ8MTXP02F39J0.19.71.G05.1.454.CMB.2.raw
  modified_base (238)..(238): a, c, t, g, unknown or other
  modified_base (250)..(250): a, c, t, g, unknown or other
  modified_base (282)..(282): a, c, t, g, unknown or other
  modified_base (318)..(318): a, c, t, g, unknown or other
  modified_base (361)..(361): a, c, t, g, unknown or other
  modified_base (385)..(385): a, c, t, g, unknown or other
  modified_base (393)..(393): a, c, t, g, unknown or other
  modified_base (419)..(419): a, c, t, g, unknown or other
  modified_base (421)..(421): a, c, t, g, unknown or other
  modified_base (457)..(457): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccgatcaactgcaagtccagccacaatcttttanacagttaccaanaatagaaactactagcttaggtaccagcaganaccaggacagcctccgtaggcctgctctatttacgngggctagtcctacccggggaatcccgggggtcctaggacccgnttcgaggtcggccagggccgggtntagggacngtatttcactctcacatcagcagccngngagctagagtagtgtagtacttagtttattagttanaactaaataattaatttaacgttacgttacgttacggtacggttaaccggttacgggaaaccggtaaacggggtaaaccgtaagggtacgtaacgttaacgtaacgtaacggtaacgtaacggttacgggtacgtacgtaccggtacctaaccg

SEQ ID NO: 430801 - DNA, 562 bp, Homo sapiens
  misc_feature: GZ8MTXP02JXW11.19.71.G05.1.454.CMB.2.raw
  modified_base (242)..(242): a, c, t, g, unknown or other
  modified_base (257)..(257): a, c, t, g, unknown or other
  modified_base (325)..(325): a, c, t, g, unknown or other
  modified_base (420)..(420): a, c, t, g, unknown or other
  modified_base (424)..(424): a, c, t, g, unknown or other
  modified_base (447)..(447): a, c, t, g, unknown or other
  modified_base (454)..(454): a, c, t, g, unknown or other
  modified_base (533)..(533): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatacaactgacaagtccagccactaattctttanactagttacccaaanaatagaaaactacttagcttaggaccagcagagaccaggacacgcctcctaggctgctactatttcgngggcatccgtaaccccggggatccccggggtccccctaggacctattccgagtggcagggcgggtgtggggacaggtactttcgactctacaccntcancgagcctgccgaggtcagaaagngtggtgntagtttattatgtactaataattattacttatactcgttaggacgttacgaccgaaagggtacctaagggtcgaattanaacgacgtacgtacgtagtcgactacgac

SEQ ID NO: 430802 - DNA, 731 bp, Homo sapiens
  misc_feature: GZ8MTXP02I5PIH.19.71.G05.1.454.CMB.2.raw
  modified_base (246)..(246): a, c, t, g, unknown or other
  modified_base (359)..(359): a, c, t, g, unknown or other
  modified_base (429)..(429): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggcaaccatcaactgacaagtccacgccaactaattcttttanactacgttaccaaactaatagtaaaaccttacttagtacttacggtaacccagaccaaggacgaaccgaacggacacgtccctaccgtaggtcctgcttactaattttaccgnggggacctacgtcccggtaacccggggtaacgtccccggggtccccctgacccgtattcgaggtcggacnggggccggtacgtggggacctaggtactttccactctaccaaccctataccaggccacgtcctacgaccgacgggctaaggaaacgtagttcggtacgggttacttaaggttttattaaggttacgtaacttaaactaaatttaatttaactttaaagttaccgtttacggggttacggttaaccgggtttaccgggaaacccggtaaaacgggggaacccgttaaaagggggtacggttaaacttacgtaaccggaaggtaaacccggtaaaggttacggtcgggtaacgtcggtaacccg

SEQ ID NO: 430803 - DNA, 553 bp, Homo sapiens
  misc_feature: GZ8MTXP02IU1LV.19.71.G05.1.454.CMB.2.raw
  modified_base (236)..(236): a, c, t, g, unknown or other
  modified_base (312)..(312): a, c, t, g, unknown or other
  modified_base (343)..(343): a, c, t, g, unknown or other
  modified_base (376)..(376): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttaanacagttccaacaatagaaaactacttaagcttggtaccagcagagaccaggacagcctctaggctgctcatttacngggcaatcctaacccgggatccggggtcccngaccgattcgagtcgcagcggggtctgggaccngtactttcgactctcacatacagcagcctgctaggctagaagatgaggctagtttatagttgactaaacaaattattattattacgttcgtaggtacggttcgacgtaaacgggacgtaaacggttcggaatacgttacgaagaacgtaaacgtggttacggaccttagacctaacc

SEQ ID NO: 430804 - DNA, 688 bp, Homo sapiens
  misc_feature: GZ8MTXP02GUC89.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatccgtccggggacagagtcgctagcgacagtgttgcgttggcacgtgggtcaggcacgtccccagtcgagtacggtctagaggtggcgtaggggaagactatactttcagttcgtaccaacgtacgtaggaaataacgaaaatttatacgacctaacctattcgtagtttacggaaagtacgtaccgtaacgttacgaaacctaaagttaccgaaaaccggttaagaaaccctaaacgtaacgtaaccggtaaaacgtaaaccccgtaacggtttaccctaccccgttaggacccgtaacgtccgtaaccggtaccctacgttacggtaccggtaaccccgtacccgggtaaacggtaaccggttaccgggggttattaaacgttaaccgtttacggttacgggtaaacggggtaaaaccgtacccggacccccgtaaagtaaacccgg

SEQ ID NO: 430805 - DNA, 704 bp, Homo sapiens
  misc_feature: GZ8MTXP02H9IQD.19.71.G05.1.454.CMB.2.raw
  modified_base (249)..(249): a, c, t, g, unknown or other
  modified_base (479)..(479): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgaggccggccaccatcaactgacacgtccagccactaattcttttaanactacgttaccaaacaataacgtaaaactcttacgtcttacggtaccagacaggaacgaccgaggacacgtccctaccgaggctgcctactactttacgcggacacgtaccggtaaccccgggaagtccccggggtccccacggacccgtattccggaggttcggcgtacggggtccggggttacgtacgggggaacctaggttactttccgaccttcctaccaccctanaccgacgccgtacgtccgtacgacgacggtacgtaaggaagtacgttggtacgttacgtttaagttttagttacgttacgtaaactaaattaaatttaattttacgttaacgtttaccggttacggttacgggttaccggttaccggaaaccggtaaacgggtaaccgtaagggtacgtaacttaacgaacgtaacgtaacggtacgtggtacggtactacgacc

SEQ ID NO: 430806 - DNA, 655 bp, Homo sapiens
  misc_feature: GZ8MTXP02J1MQB.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggctacgtggtcaggcacgtccccagtcgaggtggtctaggaggtcggcgtaggggaaacggactagttactttcaacgttcggtaccaaacgtacgttaggaaacttaacgaaaattttacacgaccaacctattcgtagttagaagtacggttacgaacttacggaaactaagtaccgtaaaacgtacgaaaccaacgtaacgtaacggaaaacggtaaaccctacggtttacccgacccttaggaccgtaacgtccgtacggtaaccccttcgtacggtaccgtaacccgtacccggaaaggtaccggacgggttacttaaacgttaacgttaccgtaggtacggaaacgacccggacccctaagtaaaccg

SEQ ID NO: 430807 - DNA, 595 bp, Homo sapiens
  misc_feature: GZ8MTXP02I7868.19.71.G05.1.454.CMB.2.raw
  modified_base (239)..(239): a, c, t, g, unknown or other
  modified_base (250)..(250): a, c, t, g, unknown or other
  modified_base (254)..(254): a, c, t, g, unknown or other
  modified_base (264)..(264): a, c, t, g, unknown or other
  modified_base (314)..(314): a, c, t, g, unknown or other
  modified_base (347)..(347): a, c, t, g, unknown or other
  modified_base (355)..(355): a, c, t, g, unknown or other
  modified_base (367)..(367): a, c, t, g, unknown or other
  modified_base (420)..(420): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgacaagtccagccacaatcttttanactataccaanatanaaactactanctagacagacagacgaccagactacgcctacgagctgctctactttacgnggctactaccgtacccgggagtcccgggtcccncgaccgtntacaggtcgcgnggtcgggtcgtacgggacagtactttcacctcaccaccagtacacgcacgccncgcgacgacgtagagtagtagtaggtacgtagtttagttagttagtactaactaattaattaattaattacgttacgttacggttacggttaccggtaccggtaaacggtaacggtaacggtacggtaagtacgtaacgtaacgtaacgtaacgtacgtacggtacgtacgtacg

SEQ ID NO: 430808 - DNA, 599 bp, Homo sapiens
  misc_feature: GZ8MTXP02GZUCZ.19.71.G05.1.454.CMB.2.raw
  modified_base (227)..(227): a, c, t, g, unknown or other
  modified_base (237)..(237): a, c, t, g, unknown or other
  modified_base (317)..(317): a, c, t, g, unknown or other
  modified_base (350)..(350): a, c, t, g, unknown or other
  modified_base (418)..(418): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccanaattctttanacagttccaaacaatagaaaactactagcttggtaccagcagacgaccaggacagcctactaggctgctactatttacgngggctatccgtaacccgggaatcccggggtccncgacccgattcgagtggacaggcggggtctgggacagtactttcactctacactatcaagcacgtccngacgacggctagaagtagtggtacggtacttagtttattacgttactaactaaaattaatttaattaattaacgttacgtttggtacggttaccggttacggaaccggtaaacgggtaccgtaagggtacgtaacttaacgacgaacgtaacgtacgtacggtcgaccgtacgacctaacg

SEQ ID NO: 430809 - DNA, 660 bp, Homo sapiens
  misc_feature: GZ8MTXP02ITSBX.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcagacccctctcgcctcacctgtcgccatccgtccggggacagacgtcgctagcgacagtgttgccgttggcacgttgggtcagggccacgtccccagtccgaggtaggtctagaggtggcgtaggggaaaggactattactttcaagttcgtcccgaaatacggtaggaaaacttactaaaagtttagtcgaccacctagtcgttagttagaagtacgtacgtaacttagaaactaaatcgaaaacgttagacaactagtaccgtaaagaaccctacgtttaccctcccgtagaccgtaagtccgttacgaaccccgtttcgtacgtaccggtaccccttaacccgggaacgggtaccggttaaccggggttagtttaaaccttaagtttaacccgtagggttaaacgggtaaaccggacccggtacccccggtaaaataaccgg

SEQ ID NO: 430810 - DNA, 549 bp, Homo sapiens
  misc_feature: GZ8MTXP02FLK71.19.71.G05.1.454.CMB.2.raw
  modified_base (228)..(228): a, c, t, g, unknown or other
  modified_base (237)..(237): a, c, t, g, unknown or other
  modified_base (312)..(312): a, c, t, g, unknown or other
  modified_base (432)..(432): a, c, t, g, unknown or other
  modified_base (449)..(449): a, c, t, g, unknown or other
  modified_base (458)..(458): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaacaatgaaaactacttagcttggtaccagcagagaccaggacaagcctctaggctgctcatttacnggggcatcgtaaccgggtaatccggggtccccctagacccgattcgagtcggctacggccggggtctgggggaccaggtactttcactctcaccaatcagcagcctgcaggctagaaagntggtggctagtttattntagtacaanaattattattatacttcgtaggtacgtttcggaccgaaagggtaccaaaggttcggattaataacgaggtaacacgtgtacggctggaacc

SEQ ID NO: 430811 - DNA, 609 bp, Homo sapiens
  misc_feature: GZ8MTXP02G2JSW.19.71.G05.1.454.CMB.2.raw
  modified_base (439)..(439): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcgttggcacgtggtcgaggccacgtccccagtcgagaggtctagaggtggcgtacggggaaggactaagttactttcgattcgtaccgaaacgtacgtaggaaataacaaagttactgaccactagttctgtagagtacgtacgactagaaccaatacgaaacgtanaacctacgtaagtacgaaaacgaacctacgtttaccctacccgtgacgtacgtccgtacgaccgttccgtagttaccgaccgtaccccggaaggacccgtaaggggttcttaacttaacgttaacggttagggtaacgggtaacgaccccgggttacccaaagttaaccg

SEQ ID NO: 430812 - DNA, 675 bp, Homo sapiens
  misc_feature: GZ8MTXP02IK2FD.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcaccgtgtcgccagtccgtccggggacagacgtcgcgtagcgacagtgttgcgttggctacgtggtcaggcacgtccccagtcgagtagtctagagtggcgtagggaagactagtatttcgaagttcgtaccctaaagtaacggtaaggaaaacttaaaccgttaaaattacgtacgaacctaactaacgttcgtaggttaggaggtaagtccgtaaactacggtaactaaacgtaacgaaaacggttaagaaaccaaacgtaacgttaacggaaaacgtaacccgtaggttaccctcccgttagaccgtaactccgtacgaacccgtttcgtacggttaccgaacccgtacccgggaacgggtaaccgtacgggggttaactttaacgttaacgttaccggtagggtacggaaaccggtacccggtaccccgtaaaggtaacg

SEQ ID NO: 430813 - DNA, 602 bp, Homo sapiens
  misc_feature: GZ8MTXP02J1LTF.19.71.G05.1.454.CMB.2.raw
  modified_base (364)..(364): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcactgggtcaggcagtccccatcgagagtctagagtggcgtgggaacggacagtatttcatcgtccacgacgtaggaaatacaaattntagcaacctatctagtttgagtagtcgactagaactaattaccgaaacgttacggaacaaccgaacgttacgaaaacgtaacccgtaaacgtttccctacccccgttaggacccgacggtaccttacggaacccttcgtcgttacgaccgttaccccgggaaggtacccgtacggggttataacgttaacttaacgtaggttacggaacgtaaccggacccccaagttaacggaaccg

SEQ ID NO: 430814 - DNA, 623 bp, Homo sapiens
  misc_feature: GZ8MTXP02G5R8R.19.71.G05.1.454.CMB.2.raw
  modified_base (249)..(249): a, c, t, g, unknown or other
  modified_base (382)..(382): a, c, t, g, unknown or other
  modified_base (436)..(436): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtctccagacctccctggctgtgtctcgtggggcgaggccggggccaccgatacgaactgacaagtccagccactaattctttaanacagttaccaactaatacgaaaacttactagcttaggaacaagcaagaacgaaccaggtacagcctcgtaggctgctatatttacgagggcaacgtccgtaaaccggggactcccggggtcctcggaaccgtntacgaggtcgcgagcggggttcaggggacctagtactttcacttccacaaaccnctcacgcacgcctcgacgaggtactagagtgtaggtacgtatttaagttattagtactaataaactaattacttaagttacgttacgttacggtacggtaacggtaccggaacggtaaacggtacggtaacggtagtactaacgtacgtaacggtaacgtaacgtacggtacgtactacgacctacg

SEQ ID NO: 430815 - DNA, 654 bp, Homo sapiens
  misc_feature: GZ8MTXP02F2WKB.19.71.G05.1.454.CMB.2.raw
  modified_base (240)..(240): a, c, t, g, unknown or other
  modified_base (249)..(249): a, c, t, g, unknown or other
  modified_base (265)..(265): a, c, t, g, unknown or other
  modified_base (389)..(389): a, c, t, g, unknown or other
  modified_base (418)..(418): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtggggcgaggccgggcctacgactacgaaccgtgactaagtccagccanaattcttanactactacaataatanaaactactagtctagacagcagacgacagacacgcctcgagctcgcttactagtttacgcggactacgtaccgtaaccggggtacgtccccggggtacccctacgaccgtatcgaggtcggcgngggtcggtgtacggactagttacttaccnctacacacatcacgacgacgcgtcgacgacgtacgtagaagtagtaggtacggttacgttagtttaatttaacgttacgttaacgtaaacttaaactttaaactttaactttaacgttaacgtttacggttacgggttaccggttaccggtaaccggtaaacgggtaacggtaacggtaacggtaacgtaacgtaacgtaacgtaacgtaacggtacggtacggtacgtacgtacg

SEQ ID NO: 430816 - DNA, 624 bp, Homo sapiens
  misc_feature: GZ8MTXP02JXC9P.19.71.G05.1.454.CMB.2.raw
  modified_base (235)..(235): a, c, t, g, unknown or other
  modified_base (311)..(311): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcagcggccacatcaactgcaagtccagccacaattcttttaanacagttaccaataatagaaactctagcttagacagacagacgacgagacacgcctcgtagctgctactatttacgngggactactaccgtaacccgggtacgtcccggggtcctacggaccgtattccgaggtcggacgacgggtccggggtcgtaggggaacctagttactttccgacttccctaccaacctactacgacgtacgacgtccgtcgacgtacggtctaggaagtagttcggtacggtactttaagtttaatttagttacgtaactaaactaatttaactttatttaacgttacgttacgtacggttacggttaccggaacgtaaacgggacgtaaggtacgtactaagacgaagacgtacgtggacgactacgactacg

SEQ ID NO: 430817 - DNA, 552 bp, Homo sapiens
  misc_feature: GZ8MTXP02J2DOO.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacagtgttgcttggcactgggtcaggcagtccccatcgagaggtctagagtggctgggaagacatattcatgtccaacacgtaggaactacaaattagtcgcaacctatctgtttagagagtcgactgaaccaatacaacgtagaacacatcgaagaacctagttacctcccgtgaccacgctacgtaccctagtcgtacgacctcccggaaggtacgacggggttatatacgttaacgtggtaggaacggacggaccccctaagtacgaccagtacgccctaaccgtcgtctccgtggtcaccttaagg

SEQ ID NO: 430818 - DNA, 741 bp, Homo sapiens
  misc_feature: GZ8MTXP02JUIAX.19.71.G05.1.454.CMB.2.raw
  modified_base (253)..(253): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcagaccctctcgctcacctgtcgccatcgtccggggacngagtcgctagcgacagtgtgcttggcacgtggtcaggcacgtccccagtcgaggtcgtacgagtaggtcgacggtaaggggacgagtaatttactactacgttccgtaaccgaaccgtacggtaaacgtaaactaaaacgttaaatttacggtacgaaacccctaaacgttacttccggttttagggtaaacggaagggtttacccggaaccgttaaacgggtaacgaaaaccgtttaaccaaaacccggttaaacgggtaaaccgaaaccgaaacttacccggaaaaccggaaaacccgtaaaacccgtttcttacccccgttaccggactacggaccttacgggacccttaacccgtggttacggttaccgacccccggtaaaccggggacgaaaccggggtacccgggttaaagttaaactttaacgttaccgggttaggggtaaacggtaaaccgggtacccccggaaacccttaaaggaaccg

SEQ ID NO: 430819 - DNA, 629 bp, Homo sapiens
  misc_feature: GZ8MTXP02J1OEH.19.71.G05.1.454.CMB.2.raw
  modified_base (464)..(464): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgacccctctcgctcacctgtcgccatcgtccggggacagacgtcgctagcgacagtgttgcttggctacgtgggtcacggcacgtccccagtcgaggaggtctaggagtggcgtaggggaacgactattacgtttcatcgtaccaacgtacggtaggtaaaacttaacaaaatttagacgacccaaacctattcgttggttagagtacgtacgactagaacaatacaaacgtagaacaacatacgaaanaacccgttacgttcctacccgtagaccgtacgtctacgtaaccgttcgtacggttacggaacccgttacccgggaaagggaccgtaacggggtacttaacgttaacgttaacggtagggtaaccgggaaacgtaaccccgggtacccctaaaggtaacgtaaccg

SEQ ID NO: 430820 - DNA, 614 bp, Homo sapiens
  misc_feature: GZ8MTXP02HSVSJ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgacccctctcgcctcacctgtcgcccatccgtccggggacagacgtcgctagcgacagtgttgcgttggctacgtgggtcaggcacgtccccatcgaggaggtctagagtggcgtaggggaagactattatttacagttacgtacccaaacgtacggtaggaaacttaaacgaaatttatacgactaacctattcgtaggttagaagtacgtcgaactagaacctaaataccaaagtacgaaacactaagtaacgaaacgtaacctacgtttaccctacccgtagaccgtagtacctcgaacccttccggtagtcgtaaccctcccggaaaggtaccgtacgggttataactaacgttacggtaggtacggaacgtaacccggaccctaaggtaacg

SEQ ID NO: 430821 - DNA, 581 bp, Homo sapiens
  misc_feature: GZ8MTXP02JKKKB.19.71.G05.1.454.CMB.2.raw
  modified_base (383)..(383): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagagtcgctagcgacagtgttgcttggcacgtgggtcaggcacgtccccatcgagaggtctagagtggcgtaggggaaggactattactttcgattcgtccaaacgtacggtaggaaataacaaatttangacacctatctgttgagtagtcgactgacaatacaaacgtagacacatacgaaacgaacctacgttcctacctcgcagtcctacgaccctcgtcgtacggaccgttacccggaacggaccggtaacggggttacgttaacgttaacgttaacgttcggttaacgggaaacggtaccggtacccccgaagttaaaccgg

SEQ ID NO: 430822 - DNA, 695 bp, Homo sapiens
  misc_feature: GZ8MTXP02F3MQU.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccacgtcgtccggggacagacgtcgctagcgacagtgttgcttggcacgtgggtcaggcacgtccccagtcgagaggtctaggagtggcgtaggggaaaggactaattactttcaagttcgttacccgaaacgtaacggttagggtaaaacttaaaccgtaaaatttacacggtaacctaaccctaagttccgttaggtttagaacgtacggtccgaacgttacggaactaaacgtaccgtaaaacgggttaacgaaacctaactaagttaccgaaaacggtaaaccctaaccgtttcctaaccccgttgacctacggtacctacggtaaccccttacgtcggttaccgtacccgttacccgggaacggtaacccgtaacgggggttcttaaacgttaacgtttaacccggtaggttaacggggaaaccgaccgggtaccccctaaagttaacccgg

SEQ ID NO: 430823 - DNA, 564 bp, Homo sapiens
  misc_feature: GZ8MTXP02IC0OC.19.71.G05.1.454.CMB.2.raw
  modified_base (239)..(239): a, c, t, g, unknown or other
  modified_base (315)..(315): a, c, t, g, unknown or other
  modified_base (363)..(363): a, c, t, g, unknown or other
  modified_base (370)..(370): a, c, t, g, unknown or other
  modified_base (419)..(419): a, c, t, g, unknown or other
  modified_base (425)..(425): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanacagttccaacaatagaaaactatagcttaggtaccagacagagaccaggacacgcctctaggctgctcatttacngggcatccgtacccggatccggggtcccctgaccgtatcgagtcggcngcgggtntgggactagtctttcactctcacatcagcagcctgcgaggctagaaagngttagnggtacttagttttattaagttgtaacctaaataattatttaatattacgttcggtacggtacggtttcggactaaacggggacctaaagggtcggtattaagtcgtaacggacgtaaaccgtggtaggcttacggaccc

SEQ ID NO: 430824 - DNA, 623 bp, Homo sapiens
  misc_feature: GZ8MTXP02GXX1P.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagacgtcgctagcgacagtgttgcttggcacgtgggtcaggccacgtccccatcgagaggtctagagtggcgtaggggaagactatatttcattcgtccaaacgtacggtaggaaataacgtaaaatttagtacgaccaacctaattcgtaggttaggaagtagtaccgaacttaggaaactaaataccgaaaacgttagaaaccaactaacgtaccggaaaacgtaaacccctaacggtttacccaccccgttaggaccaacggtctacgtacccttcgtggtaccgaccgtacccgggaacgaccgtaaccgggttagtaacttaacgttacgtacggtacggaaacgccggtaccccgtaagtaaccg

SEQ ID NO: 430825 - DNA, 664 bp, Homo sapiens
  misc_feature: GZ8MTXP02JCUJG.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgtgcttggcacgtgggtcaggcacgtccccatcgagaggtctagagtggcgtggggaagactatatttcagttcgtccaaacgacggtaggaaactaactaaaatttatcgacctacctaattcgttaggttaggaagtacgtaccgaactagaacctaaagtaccgaaaacggtagaaccaacgtaataaccggaaaacgtaaacccgtacgttacctccccgtaggcctaaggccttaacgacccgttcgtacggtttaccggaaccccgttacccgggaaacgggtaacccgtaaccgggggttacgtttaaaattaacgtttaaccggtacgggttaaacggggaaaaccggtaaccccggggttaaccccccaaaggtttaaaacccgg

SEQ ID NO: 430826 - DNA, 600 bp, Homo sapiens
  misc_feature: GZ8MTXP02GJ73Q.19.71.G05.1.454.CMB.2.raw
  modified_base (241)..(241): a, c, t, g, unknown or other
  modified_base (253)..(253): a, c, t, g, unknown or other
  modified_base (258)..(258): a, c, t, g, unknown or other
  modified_base (321)..(321): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccactaattcttttanactattaccaanaatanaaactacttagcttagaccagacagacgaccgaggacacgcctcgagctgctactatttacgnggactacgtaccgtaacccgggtacgtccccggggtaccccctacggtaccgtagttcgaggtcggacgtcgggtccgggtcgtaggggactagtactttaccacctcctaccacctatacgagcgacgccgtgacgaggtacgtagaagtgtggtaggtattagtttattagtacgtaacaaattaattatttattatacgttcggtacggtacgtacggaacgtaagggtacgtaaggtacgtattagtaacgaagtacgtacgtgacgtcgtacgc

SEQ ID NO: 430827 - DNA, 594 bp, Homo sapiens
  misc_feature: GZ8MTXP02JED8A.19.71.G05.1.454.CMB.2.raw
  modified_base (243)..(243): a, c, t, g, unknown or other
  modified_base (255)..(255): a, c, t, g, unknown or other
  modified_base (324)..(324): a, c, t, g, unknown or other
  modified_base (410)..(410): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactgcaagtccagccaacaattctttanacagttccaaanaatagaaaactactagcttaggaccagcagagaccaggacagcctacgtaggctacgctctatttacgngggctacgtccgtaaccccgggaagtccccggggtcccctcggaccgtagttccgagtcggcaggggtcgggtactgggggaaccngttactttcactcctacaccatacagcacgcctgacgtaggctagagatggacgtagtagtttattattacgaactaactaattattaattactacgttgtacggtacgttcggaaccgaaagggtaccgtaggtacggtaataacgtcgaacgaacgtaacgtggtacggaccttaggaaccc

SEQ ID NO: 430828 - DNA, 623 bp, Homo sapiens
  misc_feature: GZ8MTXP02GC559.19.71.G05.1.454.CMB.2.raw
  modified_base (241)..(241): a, c, t, g, unknown or other
  modified_base (254)..(254): a, c, t, g, unknown or other
  modified_base (322)..(322): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatcaactgcaagtccagccacaattctttanacagttaccaaanaatagaaaactacttagcttaggaccagcaagagaccaggacagcctacgaggctgctctatttacgnggactacgttccgtaacccggggtaacgtccccggggtcccctacggaccgtattccgaggtcggcagggccgggtctggggactagtactttcactcctacaacctatacgacgcacgccctagaccgaggctagaaagtgtggtaggacttaagtttagtattcgtaacaaacttaattaatttattaacgttacgtttcggtacggttaccggtttacggaacccggtaaaaggggtaccgtaaaggggtcgtaattaataaccgaaggaaccgtaacgtggtacggctacggtaacc

SEQ ID NO: 430829 - DNA, 553 bp, Homo sapiens
  misc_feature: GZ8MTXP02FM9PJ.19.71.G05.1.454.CMB.2.raw
  modified_base (222)..(222): a, c, t, g, unknown or other
  modified_base (307)..(307): a, c, t, g, unknown or other
  modified_base (368)..(368): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccggactggtgaagccctgcagacccctntcgctcacctgtgcccatcgtccggggacagagtcgctagcgacagtgttgcttggcacgtgggtcaggcacgtccccatcgagnggtctagagtggctgggaagacagtatttcatcgtaccagacgtaggaaatacaaatttangacaccatactgttgagagtcgactgacaatacaacgtagacacatacgaacgaactagtacctccctagacagtcacgtacctcgtacgtacgaccgttcccggaacggacgtaccggggtagtaacttaacgttaaccgtaggttacggaaacggtaccggaccccctaagtaacggtaaccg

SEQ ID NO: 430830 - DNA, 721 bp, Homo sapiens
  misc_feature: GZ8MTXP02HCHS7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagacgtcgctagcgacagtgtgcgttggcacgtgggtcaggcacgtccccatcgagtaggtcgtgggagtggcgtaggggaagactagttatttcgagttcgtacccaaacgtacgggtaaggtaaaacttaaccgtaaaagtttacgtacggaccctaacctaacgtttcgttagggttaggaacgggtaacgttaccggaacttaacggaaacctaaacgttaaccgtaaaaccggttaacggaaaccaaaccgtaaacgttaacccggaaaacggttaaaccccgttaacggtttacccctacccccgttaggaccctaacgggttccctaaccgtaaccccgtttcggtacggttaccggaaccccgttaacccgggaacggtaacccggtacggggttactttaaacgtaacgtttacgtacgggtaacgggtaaacggacccggtacccctaagtaaccg

SEQ ID NO: 430831 - DNA, 694 bp, Homo sapiens
  misc_feature: GZ8MTXP02I2A50.19.71.G05.1.454.CMB.2.raw
  modified_base (383)..(383): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtagaacgccctcgcacgaccctctcgctcacctgtcgcctagtccgtaccggggacagacgtccgcgtaggcgacgtagttgttcgtcgttggcacggtgggtacgacggcgtaccgtccccagtcggaggacggtctaggaggtggcgtaggggaagactattattcatcgtaccaacgtacggtagaactaactaaattancgacactatcgtgtagagtacgtcgtatagaactaatacaaacgtagaaccaactaacgtaacggaaacctaaacgtacgtttacccacccgtagaccgacgttccgtaccggtaccttcgtacggtaccgaaccccgttaccggaaggtaccgtaacggggttattaacgttaaacgtttaccggtaagggtaaacgggaaaccggaccccgggtaaccccctaaagtaccggtaaacccgtaggttacccgaaccccgttaacccggttaccgttccgttaccggtggtttacgtacgtttaaacgggg

SEQ ID NO: 430832 - DNA, 699 bp, Homo sapiens
  misc_feature: GZ8MTXP02GPF61.19.71.G05.1.454.CMB.2.raw
  modified_base (237)..(237): a, c, t, g, unknown or other
  modified_base (316)..(316): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccactaattcttttanacagttaccaaacaatagaaaactacttagcttaggtaccagcagagaccaggacagcctcaggctgctctatttacgngggactagtccgtaacccggggaattcccgggggtaccccctaggtaaccccgtatttaccgaggtcggccgacggggtccggggttactagggggaacctaggtacttttccgaaccttcgtacccaccctaatccgaacgtccaacgcccgttagaccggtaacgggacctaggaaaagtgttagggtacgggtacttaaggtttttaactttaattacgtaaccaaaattaaattaatttaagttactttaccgttaggtacggttaccggttacggaacccggtaaagggtaacccgtaaagggttacggtaacttaacggtaaccgtaacggtaaaccggtaaaaccgttgggtaacggtacccgttaggaaaccccg

SEQ ID NO: 430833 - DNA, 670 bp, Homo sapiens
  misc_feature: GZ8MTXP02IWCZR.19.71.G05.1.454.CMB.2.raw
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagacccctctcgctcacctgtcgcccatcgtccggggacagagtcgctagcgacagtgttgcttggcacgtggtcaggcacgtccccatcgagaggtctagaggtggcgtaggggaaggactagttatttcgaattcgtaccaaacgacggtacggaaataacgtaaaatttagtacgaccctaactattacgttaggttaggaagtacgtaccgaacgttagaaacctaaagttaccgaaaacgttacgaaacctaacgaagtaccgaaaacggtaaacccgtacgtttaaccctaccccgttagaccgtaacggtacctacgtaaaccccttcggtacgtaccggtaaacccgtcccggaaacgggtaaccgtacggggttattaaacgtttaacgttaaccgtttacggggacggtaaaaccggaccccgggaaccccctaaaggtaacccg

SEQ ID NO: 430834 - DNA, 661 bp, Homo sapiens
  misc_feature: GZ8MTXP02FKBK8.19.71.G05.1.454.CMB.2.raw
  modified_base (479)..(479): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtagaacgccctcgcacgacccttctcgctccacctgtcgccatccgtaccggggacaggacgtcgctaggcgactaggttcgttgcgtttggctacggttcgggtcaggcctacgtcccccagtcggaaggtggttactaggaggtcgggacgtaggggaaaggtactattacgtttcaagttcgtaccaaacgaacgtagaaactaataaattatcgactaacctattcgtagttagagtagtaccgtaatagaactaaattaccgtaaaacgganaaacaaactaacgtaaccggtaaaacaacccgtttacgttcccttaccccgtaggaccacgtaccgtacggtaaccgttactcgggtacctaaccggtaccccggaaagggtaaccggtacgggggttaattaacgtaaacgtttgacgggttacgaacggtacccggacccaaggtaaacg

SEQ ID NO: 430835 - DNA, 554 bp, Homo sapiens
  misc_feature: GZ8MTXP02GF8IK.19.71.G05.1.454.CMB.2.raw
  modified_base (240)..(240): a, c, t, g, unknown or other
  modified_base (252)..(252): a, c, t, g, unknown or other
  modified_base (315)..(315): a, c, t, g, unknown or other
  modified_base (363)..(363): a, c, t, g, unknown or other
  modified_base (372)..(372): a, c, t, g, unknown or other
  modified_base (403)..(403): a, c, t, g, unknown or other
  modified_base (423)..(423): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccacggggacatcgtgatgacccagtctccagacctccctggctgtgtctctgggcgagccggccaccatcaactgcaagtccagccacaattctttanacagttaccaanaatagaaactacttagcttggtaccagcagagaccaggacagcctcaggctgctctatttacnggcatccgaccgggatcccggggtacccctagacctattcgagtggcnggccgggtntagggacagtactttcactctacaccatcancacgcctgcagctagaaagngtaggtcggtactagttttaatagttacgtaacaaataaattattaattatacttcggtacggtacgttacggaccgtaaagggacctaaggtacgaattacgaacgtagaacgtaagtgtacgctagacc

SEQ ID NO: 430836 - DNA, 635 bp, Homo sapiens
  misc_feature: GZ8MTXP02GVU7D.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagtgttgcgttggcacgtgggtcagggccacgtccccagtcggaggtacggtctaaggaggtggcgtaggggaaagactaagttactttcgagttacgtacccaaacgtacggttaacggaaaattaaaccgtaaaatttatacgaccaaccgtattcgttggttacgagtacgtacgactagaactaaagtacaaacgtagaacaactacgtaacgaaacgtaaacctacgtttcctacccgtagaccgtacgtaccgtacgtaacccgttcgtacggtacgacccgtacccggaacgggtaccgtacgggttagtaacttaacgttacgtaggtacggaacgacccggacccctaagtaaccg

SEQ ID NO: 430837 - DNA, 619 bp, Homo sapiens
  misc_feature: GZ8MTXP02FVERQ.19.71.G05.1.454.CMB.2.raw
  modified_base (238)..(238): a, c, t, g, unknown or other
  modified_base (247)..(247): a, c, t, g, unknown or other
  modified_base (251)..(251): a, c, t, g, unknown or other
  modified_base (311)..(311): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcacgatacgacgtgacaagtccagccacatctttanacatacaanatanaaactatagcttgacagcagacgacgagacacgcctacgtaggctgctactagtttacgnggacacgtaccgtaccgggtacgtcccgggtcccctagaccgtattacgaggtcggcgacgggtcgggtcgtacgggactagtactttccactcctaccaccacgtacacgtacgacgaccgtacgacgagtacgtagaagtagtaggtaggtacgttagtttaagtttagttacgtactaaactaaattaatttaagtttaacttacgttacggttacggtacggttaccggtaccggtaacggtaacggtaacggtacgtaacgtaacgtaacgaacgaacgtacgtacgtacgtacgtacgtccg

SEQ ID NO: 430838 - DNA, 538 bp, Homo sapiens
  misc_feature: GZ8MTXP02FN59K.19.71.G05.1.454.CMB.2.raw
  modified_base (320)..(320): a, c, t, g, unknown or other
  modified_base (337)..(337): a, c, t, g, unknown or other
  modified_base (394)..(394): a, c, t, g, unknown or other
  modified_base (457)..(457): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcactggtcaggcagtccccatcgagaggtctagagtggctgggaaggactatattcatgtccaanacgtggaatacaaattntgcaccatctagttgagagtcgactgaacaaatcgaaacgtagacacaatacgaaanaaccagtttccaccctgacacgctacgaccttcgtgtacgacctcccggaagacgacggggtntaactagttacgtagtaggaaagaccggaccccagtacgactactcgaacctaccgtcgtactccgtaggctacgttaacg

SEQ ID NO: 430839 - DNA, 530 bp, Homo sapiens
  misc_feature: GZ8MTXP02I9L5L.19.71.G05.1.454.CMB.2.raw
  modified_base (223)..(223): a, c, t, g, unknown or other
  modified_base (373)..(373): a, c, t, g, unknown or other
  modified_base (413)..(413): a, c, t, g, unknown or other
  modified_base (420)..(420): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctntcgctcacctgtcgccatcgtccggggacagagtcgctagcgacagtgttgctttgctacgtgggtcaggcacgtccccatcgagaggtctagagtggctggggaagctatactttcattcgtccaacgacgtaggaaatacaaatttangcaccatctgttgagacgtcgatagaacattacaaacgtnaacacanacgaacgaacacgttcaccctgcctagcctacgaccctgtagtacgaccgtcccggagtacgtacgggtatataacgttacgtggacggaaacgccggacccagtaaccg

SEQ ID NO: 430840 - DNA, 500 bp, Homo sapiens
  misc_feature: GZ8MTXP02FF46X.19.71.G05.1.454.CMB.2.raw
  modified_base (467)..(467): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaaacacgtggaaatacaaaattatgacaccaatctgttgagagtcgatgacaaatcaaacgtagacacatcgaaagaacacgttctcctagcagctgacctctcgtgactcccgaggacacggggtntataattactagtaggagacggcccccataacg

SEQ ID NO: 430841 - DNA, 499 bp, Homo sapiens
  misc_feature: GZ8MTXP02JS0IH.19.71.G05.1.454.CMB.2.raw
  modified_base (239)..(239): a, c, t, g, unknown or other
  modified_base (247)..(247): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (267)..(267): a, c, t, g, unknown or other
  modified_base (272)..(272): a, c, t, g, unknown or other
  modified_base (280)..(280): a, c, t, g, unknown or other
  modified_base (282)..(282): a, c, t, g, unknown or other
  modified_base (286)..(287): a, c, t, g, unknown or other
  modified_base (289)..(289): a, c, t, g, unknown or other
  modified_base (296)..(296): a, c, t, g, unknown or other
  modified_base (324)..(324): a, c, t, g, unknown or other
  modified_base (326)..(326): a, c, t, g, unknown or other
  modified_base (328)..(329): a, c, t, g, unknown or other
  modified_base (334)..(334): a, c, t, g, unknown or other
  modified_base (337)..(337): a, c, t, g, unknown or other
  modified_base (339)..(339): a, c, t, g, unknown or other
  modified_base (364)..(364): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcaccgatacgaactgcaagtccagccacaatctttanacatcaanatanaaactntanctgacancaganacagacancncagnncnatactgnatctacgacgtcggtcccgcgacgatcngngnngcgcngananatcactctcacactacagacacgcncgacgacgacgtagaagagtgtggtagtagttaagttattagtactaaactaaataattaattaattacgttacgtacgtacgtacgtacgaacggaacgaacgagagtataagacgacgacgtacgtcgcgcgc

SEQ ID NO: 430842 - DNA, 650 bp, Homo sapiens
  misc_feature: GZ8MTXP02HAVV1.19.71.G05.1.454.CMB.2.raw
  modified_base (240)..(240): a, c, t, g, unknown or other
  modified_base (332)..(332): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggcggccacatcaactgacaagtccagccaactattcttttanacacgttaccaaacaatacgaaaactactagtcttacggtaccagcaagacgaccaaggacacgtccctcgtaggctgcctactatttacgnggacctacgtccgtaacccggggaactcccggggtacccctacggaccgtacttcggaacggtcggacgacggggtccgggtacgacggggactaggttaactttccaaccgtactaccaaacctactacgacgactacgcctagacgacgtacgtaggaaagtgtaggacggtacttagtttattagtactaactaataattattattacgttacgttacggtacggttaccgttacggaaccgtaaagggaccgtaagggtaacgtactaacgtaacgaacggtaacgtacgtacggtagtaccgtacgtaacccg

SEQ ID NO: 430843 - DNA, 578 bp, Homo sapiens
  misc_feature: GZ8MTXP02ICXKG.19.71.G05.1.454.CMB.2.raw
  modified_base (308)..(308): a, c, t, g, unknown or other
  modified_base (314)..(314): a, c, t, g, unknown or other
  modified_base (343)..(343): a, c, t, g, unknown or other
  modified_base (365)..(365): a, c, t, g, unknown or other
  modified_base (401)..(401): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacaggagtcgctagcgacagtgttgcttggcacgtgggtcaggcacgtcccatcgagngtcagngtggctgggagacatattcatcgtaccanacgttagaaacttacaaagttntgaccacctatcgtgttagagtacgtacgacgtaanaactaatacgaaacgtacgaacaagaacgtacgaaacgtaaccgtacgttcccaccgtagacgtacgtctacgtacccttcgtacgtaccggtaccgtaccggaaggtaaccggtacggttacgtttaactacgttaacgttacggaacggtaacggacccgtacccaagtacgacg

SEQ ID NO: 430844 - DNA, 558 bp, Homo sapiens
  misc_feature: GZ8MTXP02G1DMZ.19.71.G05.1.454.CMB.2.raw
  modified_base (378)..(378): a, c, t, g, unknown or other
  modified_base (451)..(451): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagtgtgcttggcacgtgggtcaggcacgtccccatcgagaggtctagagtggcgtaggggaagactagtatttcattgtccaactacggtagaaataactaaatttancgacacctatctgtagagacgtcgactgacaatcaaagtagacacatacgaaacgaacctacgttcctacccngacacgtctacgtaccttcgtacggacgtaccgtaccggaacggtacgtacggttattaacgttaacgttacgtacggtacggaaacgacccggtaccctaagtacg

SEQ ID NO: 430845 - DNA, 562 bp, Homo sapiens
  misc_feature: GZ8MTXP02IV783.19.71.G05.1.454.CMB.2.raw
  modified_base (203)..(203): a, c, t, g, unknown or other
  modified_base (347)..(347): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctcgcagaccctctcgctcacctgtgccatcgtccggggacagagtcgctagcgacagtgtgcttggcacgtgggtcaggcacgtccccatcgagaggtctagagtggctagggaacgacagtatttcattgtaccaanacgtaggaaataacaaattatagacaacatctgttagagagtacgactagaacaatacgaaacgtaagaacaaacagtacgaaacgaacctagttacctccctagacaacgctacgtaactctgtacgaccgtaccccggaaaggaacgtaccggggtactaataagttaaccgtggttaaggaaaacgaccggaacccccaagttaacgaaccg

SEQ ID NO: 430846 - DNA, 585 bp, Homo sapiens
  misc_feature: GZ8MTXP02ITBTY.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtcggggacagagtcgctagcgacagtgttgcttggcacgtgggtcaggcacgtccccagtcgagtaggtctagagtggcgtaggggaaggactatactttcattcgtccaacgtacgtaggaaattaacaaattatcgactacgtatctagttcgaagtagtcgaactagaacaatcgaaagttacgacaacgtatacgaaacgaacctagtttccctacctacggacacgtctacgaacccgttctaggtaccgacctacccggacggtaaccgacggggttactaacgttaagttaccgtaggttacggaaacggtaccgtacccccgtaagtaaaccgg

SEQ ID NO: 430847 - DNA, 766 bp, Homo sapiens
  misc_feature: GZ8MTXP02GBKA2.19.71.G05.1.454.CMB.2.raw
  modified_base (321)..(321): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgacaagtccagccactaattctttatacagttaccaacaatagaaaactcttagcttggtaccagcagagaccaggacagcctccgtaggctagctcatttacgngggcagttcccgaaccggggtaacttcccggggtccccctggacccgtagtttccaaggttcgggactacggggtccggggtaccgttagggggaaaccctaaggttaacgtttttacccaaccctttaccgttacccaaacccctaacttaccccgaagggtaaccctaaacggggcccccgtttggaaccccgtaaggggtacccgtaaaggaaacggttaagttccgggttacggggtactttaaagggttttttaactttaaaggttacgttaaaccttaaaaactaaaatttttagttttaaacctttaaagtttaacccggttttggtaaccggggttaaccggtttacgggaacccgtaaaaggggtaacccgtaaagggtacggtataacgtaacgtaaacggaccgtaaaacgttgttacgggcttacgtaacccg

SEQ ID NO: 430848 - DNA, 735 bp, Homo sapiens
  misc_feature: GZ8MTXP02IIVSK.19.71.G05.1.454.CMB.2.raw
  modified_base (239)..(239): a, c, t, g, unknown or other
  modified_base (263)..(263): a, c, t, g, unknown or other
  modified_base (322)..(322): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactcgacaagtccagccacaatctttanacagttaccaacaatagaaaactnttagcttaggaccagacagagaccaggacagccctcgtaaggctagctactatttacgngggacacgtcgtaaccccggggactcccggggtcccctggaaccccgtattccgaggtaggcctagggccggggttctagggggaacctagtaacctttcgaactcctactacccaatcacgtcgacgtccgtcgcaacggtcctagggaaactgttacgggttaggactttaaagggtttttatttaagggttacgttaaacccaaaacgttaaagttttaagttttaaactttaaagtttaaaccgttttccgggtaaacgggggtttaaacccggttttacccggggaaaaccccggttaaaaggggtaaaccccggtaaaaagggggtttccgaaaacggttttaacgaaaccgtaaacggtaaaccgtaaacggttagggtaccggtacgttaaccgtaccgtaaccg

SEQ ID NO: 430849 - DNA, 703 bp, Homo sapiens
  misc_feature: GZ8MTXP02H3Q6V.19.71.G05.1.454.CMB.2.raw
  modified_base (417)..(417): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtagaacgccctgcacgaccctctcgctcacctgtcgccagtccgccggggacaggacgtcgcgtagcgacaggtgtgcgttggctacgtgggtcacggcacggtccccagtccggaaggtacggtctaaggtaggtcgggcgtacggggaaaggtactaagttactttcgagttcgtaccaaacgtacgttaggaaacttaaactaaatttanacgacctaaccgtattacgttagtacggaagtacgtacgtaacgtaacgaactaaacgtaacgtaaaacgtaacgaaactaaacgtaaacgtaaaccggaaacgtaaaccgttaccgtttacccgtacccgtacgaccgtacggtaccgtaccgtaacccttcggtaacggtacccgtaacccgtacccgggtaacgggtaaccggttaacgggttaagttaaacgttaacgttacggttaacgggtaacggaaacccggtacccggtaacccctaaaggtaaccg

SEQ ID NO: 430850 - DNA, 688 bp, Homo sapiens
  misc_feature: GZ8MTXP02IH3AY.19.71.G05.1.454.CMB.2.raw
  modified_base (247)..(247): a, c, t, g, unknown or other
  modified_base (262)..(262): a, c, t, g, unknown or other
  modified_base (339)..(339): a, c, t, g, unknown or other
  modified_base (504)..(504): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccgatacaactgacaagtccagccaactaattcttttanactacgttaccaaanaatagtaaaactacttaagtcttaggtaccagcaagacgaccaaggacacgcctaccgtaggctgctcactttacgngggacacgtaccgtacccgggtaagtccccggggtacccctacggaccccgtatttcgaaggttcggacgtacggggtccggggtactacgggggactaacgggtctttaccaccgtctaccacctatacgacgacacgtcccgtgcgacggtacgtagaaagtnttagggtcgtagtttaaggttttattagtacgttaactaaacttaattaaatttaagtttaaacgtacgtttaccggttaggtaaccggtttaccggaaccggttaaaacggggaacccgttaaggggtaacgttataaacgtaacgtacgaaaccggtaacgtaggtacggtactacgaaccc

SEQ ID NO: 430851 - DNA, 599 bp, Homo sapiens
  misc_feature: GZ8MTXP02FR04L.19.71.G05.1.454.CMB.2.raw
  modified_base (221)..(221): a, c, t, g, unknown or other
  modified_base (307)..(307): a, c, t, g, unknown or other
  modified_base (369)..(369): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctntcgctcacctgtcgccatcgtccggggacagagtcgctagcgacagtgttgcttggctacgtgggtcaggcacgtccccatcgagnggtctaggagtggcgtaggggaacgactagtattcatcgacagacgtaggaaatacaaattngacacatctgtacgagagtacgactagaactaatacaaacgtacgaactacacgtacgaaacgtaaccgtacgttccctacccgtagaccgtaacgtcctacgtaacccgttcgtacggtaccgtaacccgttaccccgggaaaggtaacccggtacgggggttattaacgtttaacgttaacggtaggtaacgggtaaacgtacccggacccctaagtaaccgtaaccg

SEQ ID NO: 430852 - DNA, 504 bp, Homo sapiens
  misc_feature: GZ8MTXP02I7Y8C.19.71.G05.1.454.CMB.2.raw
  modified_base (226)..(226): a, c, t, g, unknown or other
  modified_base (237)..(237): a, c, t, g, unknown or other
  modified_base (380)..(380): a, c, t, g, unknown or other
  modified_base (389)..(389): a, c, t, g, unknown or other
  modified_base (425)..(425): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaattcttttanacagttaccaacaatagaaaactactagcttggtaccagcagagaccaggacagcctcctaggctgctcattactggcatctaccgggaatccggggtcctgaccgattcgagtgcacgcgggtctgggacagatttcactcnctacatcancagctgcaggctagaagtagtgtgactagtttattnttagtacaatatattaattatactgtgtacgttcgacaacggacagtgtatctacaagacgaactggacgactgactac

SEQ ID NO: 430853 - DNA, 594 bp, Homo sapiens
  misc_feature: GZ8MTXP02JQWDF.19.71.G05.1.454.CMB.2.raw
  modified_base (287)..(287): a, c, t, g, unknown or other
  modified_base (305)..(305): a, c, t, g, unknown or other
  modified_base (372)..(372): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcacgtggtcnggcacgtccccatcgagnggtactagagtggcgtggggagactagtatttcattcgtccaacgtacgtaggaaatacaaatttangaccacctattcgtgttacgagtagtccgatagaacgtaatacgaaaacgtagaaccaactagtaaccggaaacgtaacccacgtttcccacccgttagccaaggccttacggacccctttcgaggttccggaacccgtcccgggaaacggtaccgtacggggttattacgttaagttaccgttagggtacgggaacgtacccggacccccgtaataaccgg

SEQ ID NO: 430854 - DNA, 530 bp, Homo sapiens
  misc_feature: GZ8MTXP02FJEF2.19.71.G05.1.454.CMB.2.raw
  modified_base (322)..(322): a, c, t, g, unknown or other
  modified_base (341)..(341): a, c, t, g, unknown or other
  modified_base (383)..(383): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagaggtctagagtggctgggaagacatattcattgtaccaanacgtagaaatacaaattangcaccatctgttgagagtcgatgacaatcaaacgtagaacanatacgaagaacagttccaccctgacagctcgacctctgtacgacccgtccgaaggacgtacggggtatacttacgtactagggtacggaaacggaccggaccccagtaacgacactcgaaccctactcgtctcgtggtcgcgttaag

SEQ ID NO: 430855 - DNA, 635 bp, Homo sapiens
  misc_feature: GZ8MTXP02H4NON.19.71.G05.1.454.CMB.2.raw
  modified_base (239)..(239): a, c, t, g, unknown or other
  modified_base (251)..(251): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaatgcaagtccagccacaatcttttanacagttaccaanaatagaaactactagcttggtaccagcaagacgaccaggacagcctctaggctgctctatttacgnggcataccgtacccggggaagtcccggggtcccctcggaaccgtattcgaggtcggactcgggtcgggtacgtcgggactagtatttacaccgtctccaacctatcgagccacgccctgaccaggtctaaggactagtggtacgtcttaaggtttatttagttacgtactaaaactaagtttaatttaattaacttacgtttacgggttacggtaacccgttttaccggtaaacccgaaaacggggtaaccgtaaaggggttaccgtaagttacgtaacgaacggaaacgtaacgttggtacgggtacttacgacccg

SEQ ID NO: 430856 - DNA, 623 bp, Homo sapiens
  misc_feature: GZ8MTXP02FI157.19.71.G05.1.454.CMB.2.raw
  modified_base (243)..(243): a, c, t, g, unknown or other
  modified_base (257)..(257): a, c, t, g, unknown or other
  modified_base (267)..(267): a, c, t, g, unknown or other
  modified_base (320)..(320): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgactacgactcgactaagtcagccacatctttanacagttcccaaaanatagaaactntagctagacagacagacgacgagacacgcctacgtagctcgctctagttacgnggtactactaccggtaaccgggtacgtccccgggtacctagacctagttcgacggtggcgcggtcgggtacgtacggaactagtacttaccactcctaccacactacacgacgacgacgtcgacgacgtacgtagaagtagtaggtagtacgttagtttagttacgttacgtaactaactaaattaacttaacgtttaacgttaacgttacggttacggtacggttaccggtacggtaacgggtaacggtaacggtaggtacgtaacgtacgtaacgtacgtacgtacggtacggtacgtacg

SEQ ID NO: 430857 - DNA, 712 bp, Homo sapiens
  misc_feature: GZ8MTXP02G23FN.19.71.G05.1.454.CMB.2.raw
  modified_base (246)..(246): a, c, t, g, unknown or other
  modified_base (330)..(330): a, c, t, g, unknown or other
  modified_base (382)..(382): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccggccaccatcaactgacaacgtccagccactaattctttanacacgttaccaaacaatacgaaaactactagcttacggaccagcaagacgaccaggacacgcctctaggctgctctatttacgnggactacgtccgtaacccgggagttcccggggtcccctagaccgtattacgnggtacggcgcggggtccgggttcgacggggaactacggtactttaccgacctcctaccaaccctactacgacgaccgacgtcccgtggaccgtacggtacgtaaggtaacgttggttagggtacggttaacgtttaagttttaacgttaagttaccgtaaacttaaaacgttaaagtttaatttaacgtttaacgtttaccggttacggggttaacggtaacccgggtttaccgggaaccgggtaaacggggtaaccggttagggtaacggtaacgttacgtaacggtaacggtaacggttaacggtcgggtaccgtacggtacgtaacc

SEQ ID NO: 430858 - DNA, 711 bp, Homo sapiens
  misc_feature: GZ8MTXP02IJAMJ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctcttcctcttcttcctgcccgtgctgggcctcccacaaggtgtcctgtcacaagtacagctgcagcagtcagtccaggactggtgaagccctcgcacgaccctctcgctcacctgtcgccatcgtccggggacagacgtcgctagcgacagtgttgcttggctacgtgggtcaggcacgtccccatcgagaggtctagagtggcgtaggggaaggactagttatttacgagttcgtacccaaacgtaacgtacggtaaaacttaaaccgtaaaatttactacgacctaaccctagttaccgttagggtttaagaacgttaacggtaccgtaacgttacggaaacctaaaagttaccgaaaacggttaacgaaaccaaacgttaaacgtaaccggaaaacggtaaaccctacggtttacccctttacccgtagaccgtaaacgtccgttacgaacccctttcggtacggttaccggtaaaccccgttacccgggaaacgggttaaccggtaaccgggggtttattaaacgttaacgtttaacggtagggttacgggaaaaccggtaccccgggtaaccccctaagtaaacccgg

SEQ ID NO: 430859 - DNA, 622 bp, Homo sapiens
  misc_feature: GZ8MTXP02H6BI0.19.71.G05.1.454.CMB.2.raw
  modified_base (406)..(406): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgcctagtccgtccggggacagacgtcgctaggcgacgagttgttgcttggcacgtgggtcaggcacgtccccagtcggagaggtctaggagtgggcgtaggggaagactagtatttacattcgtccaaacgtacgtaggtaaataactaaattactacgacctaaccnttcgtagttagagtacgtacgatacgaactaactacaaacgtagaacacgtaacgacgaaacgaaccgttacgttaccctaccgtagactacggtactacggaacccttcgtacggttaccgacccgttacccgggaaacggtacccggtacgggttagttaaacgttaacgttaacggtacggtacggaacggacccggtacccctaagtaaccg

SEQ ID NO: 430860 - DNA, 533 bp, Homo sapiens
  misc_feature: GZ8MTXP02I28FN.19.71.G05.1.454.CMB.2.raw
  modified_base (281)..(281): a, c, t, g, unknown or other
  modified_base (337)..(337): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctgggtctcccacaaggtgtcctgtcacaagtacagctgcagcagtcaggtccaggactggtgaagccctcgcagaccctctcgctcacctgtgccatcgtccggggacagagtcgctagcgacagtgttgcttggcactgggtcaggcagtccccatcgagngtcagagtggctgggaagcatatttcatcgtaccaacacgtggaactacaaattangcaccatctgttagagtagtcgactgaacaatacaacgtagacacatacgaacaacgtagttcctacctgacgagtctacgacctctagtacgaccgtccgagacgacggtgtatagttactggtacggaagaccggaccccaagtacgacgtagtcgaaccctacgtccgtactccgtaggtacgacgtttaagg

SEQ ID NO: 430861 - DNA, 550 bp, Homo sapiens
  misc_feature: GZ8MTXP02G0UIV.19.71.G05.1.454.CMB.2.raw
  modified_base (244)..(244): a, c, t, g, unknown or other
  modified_base (315)..(315): a, c, t, g, unknown or other
  modified_base (322)..(322): a, c, t, g, unknown or other
  modified_base (375)..(375): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccgatacgaactgacaagtccagccaacaattctttanaccagttaccaacaatagaaaactacttagcttaggtaccagcagagaccaggacagcctctaggctgctntattacngggcagtcctaccggggatccggggtcctgaccgtattcgagtgcagcggtcngggacagactttcactctcaccatcagcagcctgcagtcagagagtgtgtgtagttattatagtactaataataattattaattacgttacgttacggtacgttacggtacgtaacggtaaccggaaacggtacgtacgtatacgaagacgtaacgtacgtgtcgtacgacgacg

SEQ ID NO: 430862 - DNA, 569 bp, Homo sapiens
  misc_feature: GZ8MTXP02HMQVA.19.71.G05.1.454.CMB.2.raw
  modified_base (322)..(322): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcacgtccccatcgagaggtctagagtggctgggaaggcatatttcatgtaccaanacgtaggaactactaaattatgacacctatcgtgttagagtagtccgatgacaatacaaacgtagacacagtacgaaacgtaacctagttcctaccctagacacgtctacgtacctctcggtacgaccgtcccggaggacgtacgggtattagtacttacgtaggtacggaacgtaccggacccctaagtacgaccagtccgaacccgtaccgttccgttctcggttacgtacggtactttaaacgg

SEQ ID NO: 430863 - DNA, 620 bp, Homo sapiens
  misc_feature: GZ8MTXP02JDDZG.19.71.G05.1.454.CMB.2.raw
  modified_base (236)..(236): a, c, t, g, unknown or other
  modified_base (245)..(245): a, c, t, g, unknown or other
  modified_base (247)..(247): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (266)..(266): a, c, t, g, unknown or other
  modified_base (304)..(304): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgacccagtctccagactccctggctgtgtctctgggcgagcgggccaccatcaactgcaagtccagccacaatctttaanacatacaanananaaactntanctagacanacagagacagacacgcctcgtagctgctctatttacgnggactactaccgtaacccgggtacgttcccggggtacccctgaccgtattcgaggtcggcgcgggtcggtcgtacgggactagtactttcactactaccaaccatcagcgacgccgtagacgtaggactaagaagtagttggtacggtacttagtttagtttagttacgtaactaaactaaattaatttaatttaactttacgttacggttacggttacggttaccggtaaccggtaaacgggtaaacggtaaacggtaacggtaacgttaacgtaacgtaacgtaacgtaacgttaggtacggtacgtacgtacg

SEQ ID NO: 430864 - DNA, 582 bp, Homo sapiens
  misc_feature: GZ8MTXP02IC0SQ.19.71.G05.1.454.CMB.2.raw
  modified_base (229)..(229): a, c, t, g, unknown or other
  modified_base (239)..(239): a, c, t, g, unknown or other
  modified_base (251)..(251): a, c, t, g, unknown or other
  modified_base (308)..(308): a, c, t, g, unknown or other
  modified_base (316)..(316): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccaanaattctttanacagttaccaanaatagaaaactacttagcttggaccagcagagaccaggacagcctcgtaggctgctnatttacgnggctacgtaccgtaccggacgtcccccgggtcctacgaccgtattcgaggtcggcagcgtacggtcgtagggactagttacttccactctacaccactacacgcacgccgtgacgaggtacgtaggaaagtagttggtacgtacttaagtttattagttataactaaacttaattatttaacttacttacgttcggtacggtacgttaccggaacgtaacgggacgtaaggtagtaagtacgtacgaacgacgtacgtggtacgcg

SEQ ID NO: 430865 - DNA, 713 bp, Homo sapiens
  misc_feature: GZ8MTXP02IKXRQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatccgtccggggacaggacgtcgctacgcgaacaggtgttcgcgttggcacgtcgggtacaggccacgtccccgagtaccggaggtacggtcgtaaggaggtcggggacggttaggggaaacggtactaagtttaacgttttcgaagttacggtacccaaacgtaaccgggttaagggtaaaattaaaccgtaaaatttacgtacgaccctaactagttacgttaggttagaaggtacggtaccggtaacgtaacggaaacctaaagtaaccgtaaaacggtaaacggaaaccaactaacgttaaccggaaaacggtaaacccttacggtttacccctacccgttaggacctacgtaccgtacgtaacccttcgttacggtaccgacccggttacccgggaaggtaccgtacggggttacttaacgttaacgttacgtacggttacggaaacgtccgaacccgtagaacgg

SEQ ID NO: 430866 - DNA, 537 bp, Homo sapiens
  misc_feature: GZ8MTXP02FGV8S.19.71.G05.1.454.CMB.2.raw
  modified_base (226)..(226): a, c, t, g, unknown or other
  modified_base (235)..(235): a, c, t, g, unknown or other
  modified_base (247)..(247): a, c, t, g, unknown or other
  modified_base (308)..(308): a, c, t, g, unknown or other
  modified_base (386)..(386): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttaccaanaatagaaaactactagcttaggaccagcagagaccaggacagcctcaggctgctcattacngggcatccgtaccgggatcccggggtcctgacccatcagtggcaggcgggtctgggacagatttcactctcacatcancagctagcaggctgaagagtgaggtctagtttattattgtacaaactaattaatttaatacttacgttcgtacggtacggttcggaccgaaacggggtacccaaagggtcggtaatatacaagacgaaacgtggtaggactcggacaaccg

SEQ ID NO: 430867 - DNA, 634 bp, Homo sapiens
  misc_feature: GZ8MTXP02IKE4K.19.71.G05.1.454.CMB.2.raw
  modified_base (242)..(242): a, c, t, g, unknown or other
  modified_base (253)..(253): a, c, t, g, unknown or other
  modified_base (321)..(321): a, c, t, g, unknown or other
  modified_base (382)..(382): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccatcaactgcaagtccagccacaattcttttanacagttccaanaatagaaaactactagcttaggtaccagcagacgaccaggacagcctcctaggctgctacatttacgnggactacgtccgtaccccggggatcccggggtcccctgacccgtattccgaaggtcggccnggggtccggggtacgtacgggggactagtacttttccgaacttcctacacccatcagctacgccctgcgaaggctagaaagtagtggtacggtacttaaggttttattaagttcgtaacctaaataattaatttagttaacttacgttacggtacgggttaccgttacgggaccggtaaaacggggaccgtaaagggtacggtattaacgtaacgaaacggtaaccggtaacgtgggtacggactacggacc

SEQ ID NO: 430868 - DNA, 585 bp, Homo sapiens
  misc_feature: GZ8MTXP02H3X7Y.19.71.G05.1.454.CMB.2.raw
  modified_base (244)..(244): a, c, t, g, unknown or other
  modified_base (256)..(256): a, c, t, g, unknown or other
  modified_base (318)..(318): a, c, t, g, unknown or other
  modified_base (421)..(421): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtggcgagcgggccaccgatacaactgacaagtccagccactaatcttttaanacacgtaccaanaataactaaactatagtctagacagacagacacagacacgtcctcgagctgctactattcgnggactacgtaccgtaccggacgtcccggtacccacgtaccgtatcgaggtcggacgtgggtcgggtcgtacggtactaagttcttacactcctaccaacctanacgaacgcacgtccgtgacgaggactaagagtagtggtagtattaagttattattagaaactaaattaattaattatattacgttcggttacggtaccgttacgaacgtaaacggacgtaaggtagtacataacgaaacgaacgtacgtggactacgtacaccg

SEQ ID NO: 430869 - DNA, 542 bp, Homo sapiens
  misc_feature: GZ8MTXP02I4QP7.19.71.G05.1.454.CMB.2.raw
  modified_base (309)..(309): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatcgtccggggacagagtcgctagcgacagtgtgcttggcacgtgggtcaggcacgtccccatcgagngtcagagtggctgggaagacagttatttcattcgtccaaacgtacggtaggaaatactaaatttatcgacacctatctgttagagtacgtacgactagaacaatacgaaagtacgacacgtatacgaaacgtaacctagttcctaccctagcagctagtacctctcgtcaccgtaccgacggacgtacgggtatacgtaattacgtagtacggaacgacggaccccagtaacg

SEQ ID NO: 430870 - DNA, 760 bp, Homo sapiens
  misc_feature: GZ8MTXP02IHJAF.19.71.G05.1.454.CMB.2.raw
  modified_base (280)..(280): a, c, t, g, unknown or other
  modified_base (333)..(333): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggctggtgaacgccctcgcacgtaccctctcgcctcaccgtgtcgccctagtccgtaccggggacagacgtcgctacgcgaacngtgtgcgttgctacgtgggtcaggcacgtccccagtcgaggacggtcgtaggnggtcggacgtaggggaacgtaacgtattatttacgagttcgtaccctaaacggtaacggttaaacggtaaaattaaaaccctaaaagtttaacgttcgaaccctaaacctagtttaccgttaggtttagaaccggttaagtccggtaaactacggtaaaacctaacgttaccaaaaacgggtttacgaaacctaaacgttaaacgtaaccggtaaaaccgtaaccccgttaaacgtttccccgttaacccgtacgtaccccgaaacgggttccccttaccgggtaaacccctttcggtaccggtttaaccggacccccgtaaacccggggtacgtaacccggtacggggtttaaccttaaggttaaccgttaacggttacgggtaacgggaaaacccggttcccggaacccccttaaagtaaccggg

SEQ ID NO: 430871 - DNA, 570 bp, Homo sapiens
  misc_feature: GZ8MTXP02IJKF7.19.71.G05.1.454.CMB.2.raw
  modified_base (223)..(223): a, c, t, g, unknown or other
tcagtactctcgtgcacgaccggtgctcgatttagtgtcgtcgcaagagagagggggagagtctgctgaattctggctgaccagggcagtcaccagagctccagccaatgtctgtctccttcctcttcttcctgcccgtgctgggcctcccacaaggtgtcctgtcacaagtacagctgcagcagtcaggtccaggactgggtgaacgccctgcagacccctntcgctcactgtcgccatcgtccggggacagagtcgctagcgacagtgttgcttggcacgtgggtcaggcacgtcccagcgagagtcagagtggacgaggggaacgactattagtttcagttcgtaccacgtacggtagaaactactaaaatttgacgaccactatcgtagttagagtagtacgactagaacaatacgaaacgtaacgacaactaacgttaacgaaacgtaaccgtacgttacctacccgtacggacacgtactacgtacctcgtcgtacgtaccgtaccgacggaacgtacggtacgttatacgtaacgtcggtaacgtacgacgacccagtacgac

SEQ ID NO: 430872 - DNA, 602 bp, Homo sapiens
  misc_feature: GZ8MTXP02JHDZE.19.71.G05.1.454.CMB.2.raw
  modified_base (331)..(331): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccaccatccaactgacaagtccagccaacaattctttaatacagttaccaaacaatagaaaactactagcttaggtaccagacagaagaccaaggaccagcctcgtaggctgctatatttacgngggctacgtccgtaccccggggaacgttcccggggtccccctaggaccgtattcgaggtcggcgcgggtcggggtacgtaggggaccaggttctttaccacttccacctaccatcacgcacgcctagcagggctagaaagtgtggtggtacttagtttaattagttagaactaaaataattattatttactagttcgtacggtacgtcggacgaaagggaccgtaagggtacggtaatatcgaacgaaccgtaagtcgaggtcctacgacc

SEQ ID NO: 430873 - DNA, 620 bp, Homo sapiens
  misc_feature: GZ8MTXP02ISBYV.19.71.G05.1.454.CMB.2.raw
  modified_base (250)..(250): a, c, t, g, unknown or other
  modified_base (335)..(335): a, c, t, g, unknown or other
  modified_base (476)..(476): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccaccgataccaacgtgactaagtccagccaataattcttttaanactagttacccaaactaatagaaaacttactagcttaggtaccagcagagaccgaggacagcctcgtaggctgctctatttacgngggcactccgtaaccggagtcccggggtcctacgattcgagtggctaggcgggtctagggacagtacttccactctacaccatcgacgcacgcctgccaggctagaagtgtggtaggtactagttttatagttaccgtaanaaacttaattaatttaattaattacgttacggtacgtaccggtttaccggaaccgttaaacggggaacccgttaaagggtacggtaataacgttccgaaaagaaccggttaacggtacggtacgtacgtacgtacctacgtacg

SEQ ID NO: 430874 - DNA, 616 bp, Homo sapiens
  misc_feature: GZ8MTXP02FKGID.19.71.G05.1.454.CMB.2.raw
  modified_base (493)..(493): a, c, t, g, unknown or other
  modified_base (564)..(564): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttctcctgccgtgctgggcctccacaaggtgtcctgtcacaagtacagctgcagcagtcaggtccaggactggtgaacgccctcgcacgaccctctcgctcacctgtcgccatccgtccggggacaggacgtcgctagcgacgagtgtgtcttggctacgtgggtcaggccacgtccccagtcgagaggtctagagtggcgtagggaagactattatttacagttcgtaccaaacgtacggtaggtaaactaaactaaattactacgaccacctattacgtggttagaagtacgtacgtacgtagaacctaaatacgaaacgtacgaaccactaagtaaccgaaaacgtaaacctaccgttacccnccctaggactacgtcgtacgtaccctacgttacggtacctaccgtacccggaaacggaccgttaacgggtnttaaacgtaagttacgtaggtacgggaacgtaccggtacccctaagtaaccg

SEQ ID NO: 430875 - DNA, 710 bp, Homo sapiens
  misc_feature: GZ8MTXP02IA9PZ.19.71.G05.1.454.CMB.2.raw
  modified_base (317)..(317): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttctcttcttctgccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgttgcttggcacgtgggtcaggccacgtccccagtcgaggtaggtctaggngtcgggcgtaggggaagtacctagtttactttcattcggtacccaacggtaccggttaagggaaaactttaaacgtaaaacgttttacgcgaaccctaacccgttaagtcccgtttagggtttaggaaacggtaacggttacggtaaccgttacgggaaacctaaaacgttaccgaaaacggttaacggaaaccgtaacctaaacgttaaccggaaaaccgtaaacccgttaacggtttacccctaccccgttaggacctacggtcctaccggtaacctttccgtacggtaccgtaacccgttaccgggaaacgggttaccggacggggttatttaacgttacgttaacgttcggaacgggtaaacgacccggacccctaagttaacgaaccg

SEQ ID NO: 430876 - DNA, 596 bp, Homo sapiens
  misc_feature: GZ8MTXP02IK5X6.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactagtgaagccctcgcagaccctctcgctcacctgtgccatcgtccggggacagagtcgctagcgacagtgttgcttggcacgtggtcaggcagtccccatcgagaggtctaggagtggcgtaggggaagacattatttcatgtaccaagacgtaggaactaacaaattatgacacctatcgttgttagagtagtcgatagacaatacaaacgtagaacactaatacgaaagaacctagttcctacccgagaccgacgtctacgtacccttctacggtacgacccgtaccggaaggtaccgtacggggtattaacgtacgttaacgtagggtaacggaaacggaccggaccccaaagttaacggacctagtaccgaaccctacgttaccgttaccgtacgttcggtactacgtttaacgg

SEQ ID NO: 430877 - DNA, 626 bp, Homo sapiens
  misc_feature: GZ8MTXP02I1TMZ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgccctcgcacgaccctctccgctctacctgtcgccacgtccgtccggggacagacgtcgacgtagcgacgagtgttgcgttggctacgtggtcgacggccacgtcccagtcggagtacggtcgtaggagtcggcgtaggggaagactagttacttacgagttacgtaccgaaacgtaacggtagtaaactaaactaaattacgtcgacctactattacgtaggttagagtacgtacgaacgtacgaactaataccgaaacgtaacgaaacaacgtagtaaacggaaacgtaaaccctacgttacctccgacgacgtaacgtctaccgtaccttcgtacgtaccgtacccgtaccggaacggtaccgtagggttataacgttaagttaaccgtggtaacggacgaccggcccaagtaccg

SEQ ID NO: 430878 - DNA, 607 bp, Homo sapiens
  misc_feature: GZ8MTXP02HGNEN.19.71.G05.1.454.CMB.2.raw
  modified_base (244)..(244): a, c, t, g, unknown or other
  modified_base (322)..(322): a, c, t, g, unknown or other
  modified_base (329)..(329): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgacgcgggccaccatcaactgacaagtccagccacaattctttaanactagttaccaaataatacgaaaacttacttagcttaggaaccagcagacgacaggacacgcctacgtaggctgcctnatttacnggctatccgtaaccgggacgtccgggcccctagaccgtattcgagtcggcagggccgggtctagggacagtctttcactctaccacatcagcagccgtcgccgagctagaaagtgttggtcgggtattaggttttaattagttacgaactaaaacttaattaaactttattaacgtttacgttacgggttacggtaaccggtttacgggaacccgtaaaaggggaccgtaaagggtacgaattaaagccgaaagaccgtaacttggacgtctacgacc

SEQ ID NO: 430879 - DNA, 639 bp, Homo sapiens
  misc_feature: GZ8MTXP02HMGVJ.19.71.G05.1.454.CMB.2.raw
  modified_base (308)..(308): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgcccatcgtccggggacagagtcgctagcgacagtgtgcttggcacgtgggtcaggcacgtccccatcgagnggtctagagtggctagggaagacatattcattgtaccaacacgtaggaaataactaaatatagacaccatcgtgttagagtagtacgtaacgtagaactaaataccgaaaacgttacgaaacctaacgtaagtaacggaaaacggtaaaacccctacggtttaccctacccccgttaggaccctacgtaccgttacggtaaaccccttcgttacggttacgaaccccgttaccccgggaaacggtaccgggtaaccggggttattaaacgttaagtttaccggtaggttacgggaaaacggtacccgggtaaccccctaaagtaaacccgg

SEQ ID NO: 430880 - DNA, 641 bp, Homo sapiens
  misc_feature: GZ8MTXP02JY0F8.19.71.G05.1.454.CMB.2.raw
  modified_base (243)..(243): a, c, t, g, unknown or other
  modified_base (319)..(319): a, c, t, g, unknown or other
  modified_base (373)..(373): a, c, t, g, unknown or other
  modified_base (478)..(478): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccggccaccatcaactgacaagtccagccactaattctttanacagttaccaacaatagaaaactctagcttaggaccagcagagaccaggacagcctcgtaggctgctcatttacgnggcatccgtacccggggaagtcccggggtcccctgaccgtattcgaggtcggcngggtccggggtcgtacggggacagttactttccaaccgttcctaccaaccctataccgacgccacgcccgtagacgacggctaggaaacgtagttggtacgggtnttaaggttttattaagttacgtaactaaactaaatttaatttaattaacgttacgttcggtacggtaaccggttccggaaccgtaaacggggaccctaaaggggtacggtaacttaacgaacgtaaacggtaccgtaaacgttggtaccggtcgtacgacccg

SEQ ID NO: 430881 - DNA, 725 bp, Homo sapiens
  misc_feature: GZ8MTXP02FS0HQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccactccgtccggggacaggacgtcgcgtagcgactagtgttgcgttggcacgtgggtcaggcacgtccccagtcggagtacggtcgtaggaggtcgggcgtaggggaaaggactaattactttcaacgttcgtacccaaacgtaacggtaaggtaaaacttaacgtaaaatttacgtacgtacctaacccgtaacgttccgttagggtttaggaacggttaacggtaccggtaaacgttacggtaaacctaaaacgttaccgtaaaacggttaacgaaacctaaccgtaagttaaaccgggaaaacgtaaacccgttaaccgtttacccttacccgtagtaccgacggtaccgtacgtacccgttacgttcgtaccggtacccgttaacccccgggaaggtacccgtaacggggttacttaaacggttaacgtttaccggtacggttacgggaaaccggtacccggaacccccgtaagtaaaccgg

SEQ ID NO: 430882 - DNA, 544 bp, Homo sapiens
  misc_feature: GZ8MTXP02GPLAW.19.71.G05.1.454.CMB.2.raw
  modified_base (92)..(92): a, c, t, g, unknown or other
  modified_base (228)..(228): a, c, t, g, unknown or other
  modified_base (239)..(239): a, c, t, g, unknown or other
  modified_base (314)..(314): a, c, t, g, unknown or other
  modified_base (413)..(413): a, c, t, g, unknown or other
tcagtactctcgtgcacgaccggtgctcgatttagtgtcgtcgcaagagagaggggggaggtacaacaggcaggcaggggcagcaagatggngttgcagacccaggtcttcatttctctgttgctctggatctctggtgcccacggggacatcgtgatgacccagtctccagactccctggctgtgtctctgggcgagcgggccaccatcaactgcaagtccagccanaattcttttanacagttccaacaatgaaaactacttagcttggtaccagcagagaccaggacagcctcctaggctgctcatttacnggcatctacccgggatccggggtcccctgaccgattcagtcgcagcgggtctgggacagtatttcactctcaccatcagcagcctgcaggctagaaagntggtggactagtttattattgtacaaataattattattatacttcgtacggtacgtttcggaccgtaaaggggaccctaaagggtcggaattagtccgaagtaccgtaaactggtacggtactcggaaccc

SEQ ID NO: 430883 - DNA, 597 bp, Homo sapiens
  misc_feature: GZ8MTXP02FK88Y.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctccacctgtcgccatccgtccggggacaggacgtcgctagcgactagtgttgcttggcacgtgggtcaggccacgtccccagtcgagaggtctaggagtggcgtggggaagactatatttcagttcgtccaacgacggtaggaaataactaaaattatacgacaccgtattcgtagttagaagtagtacgtactacgaacaaactacaaacggtagaactacgaacgtacgaaaacgaaccgtaacgttccttacccgtagacccagtccgtacgacccttcgtcgtaccgaccgtacccggaacggaccgtacggggtataacgttaagtttacgtaggtacggtaacgaccggaccctaagtaacg

SEQ ID NO: 430884 - DNA, 715 bp, Homo sapiens
  misc_feature: GZ8MTXP02IAXWE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgcccctcgcacgacccctctcgctcacctgtcgccatccgtccggggacagagtcgctagcgacagtgttgcttggcacgtgggtcaggcacgtccccatcgagaggtctagagtggctggggaagcattatttcattcgtccaaacacggtaggaaacttactaaaagtttactgacctaacctattactggttagaagtagtccgaattacggaactaaacgttaccgaaacgttaacggaaccctaacgaagttaacccgaaaacggaaaaccccttacggtttacccgtacccccttaggaacccgtacgtacccgttacgaacccccgtttacggttcgggtttacccgaaccccggtttaaacccccggggaaaaggggtaccccggtttaaaccggggggttactttaaaagttaacggttttaacccggttaacgggggtttacccgggggtaaaacggaacccccgggggttaaccccccaaggtttaaaaccccggg

SEQ ID NO: 430885 - DNA, 586 bp, Homo sapiens
  misc_feature: GZ8MTXP02GFVRM.19.71.G05.1.454.CMB.2.raw
  modified_base (238)..(238): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccacaattctttanacagttaccaaacaatagaaaactcttagcttaggaccagcagagaaccaggacagcctcgtagctgctctatttacgnggactacgtaccgtaccggacgtcccgggtcccctagaccgtatcgagtcgacgcgggcggtcgagggactagtacttcactctacacatcagcacgcctgacgagctagaagtgtggtagtagttagtttaatagttacgtaactaaacttaaatttaatttaattaacgttacgttacggtacgggtaccgttaccggaaaccgtaaacgggtaacgtaagggtacgtaatagtaacgaacgaaacgtacgtgtacgacgtacgacc

SEQ ID NO: 430886 - DNA, 603 bp, Homo sapiens
  misc_feature: GZ8MTXP02HSB4A.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctcgcacgaccctctcgctcacctgtgccatcgtccggggacagacgtcgctagcgacagtgtgcttggctacgtggtcaggcacgtccccagtcgaggtaggtctaagaggtggacgtaggggaaggactattatttcagttcgtaccaaacgtacggtagtaaataactaaattatacgacctaccattcgtggttagagtacgtacgactagaaacctatacgaaaacgtagaaaccaactaacgacgaaaacgaacctaacgttcctacccacggaccaacggtcctacgtaacccttcgtacgtacgaccgtaccccggaaggaccgtacggggttataagtaacgttacgaggttaacggaaacgacccggtacccctaaggtaaccg

SEQ ID NO: 430887 - DNA, 680 bp, Homo sapiens
  misc_feature: GZ8MTXP02HJX72.19.71.G05.1.454.CMB.2.raw
  modified_base (244)..(244): a, c, t, g, unknown or other
  modified_base (327)..(327): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaagtccagccactaattcttttanacagttaccaaacaatagaaaactacttagcttaggtaccagcagagaccaggacagcctccgtaggctgctactatttacgngggcacgtccgtaacccgggaagtcccggggtccccctagaccgtattccgaggtcggcgagggtccgggtcgtaggggacctaggtactttacaccgtctcaacccgtatccagccgagccctagcgacggctagaaagtagtggtacggtacttaggttttaattacgttagtaacctaaaacttaatttaatttaactttaacgttaccgtttacgggtacggttaaccgggtttaccggaacccggtaaaacgggggtaacccgtaaaggggttacgggtaaattaacggtaaccgtaaagggtaaccccgttaaaacggtgggtccggtaaccgttacggtaaccccg

SEQ ID NO: 430888 - DNA, 707 bp, Homo sapiens
  misc_feature: GZ8MTXP02IP32L.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgcctagtcgtccggggacagacgtcgctagcgacagtgtgcgttggcacgtgggtcagggccacgtccccagtcggagtacggtcgtaggaggtgggcgtaggggaaacggactaagttatttcgaagttccgtaccgaaacgtacggttagggtaaaattaaccgtaaaatttagtacgacctaactacgttcgtaggttaggtaagtaacgtccggtaaacttacggaaactaaactaccgtaaaacggttaacgaaaccgaaactaacgttaaccggaaaacgtaaaaccccgtaacgtttcccctacccgttacggacctaacggtccgtacgtaaccccgttcgtacggttaccggaacccgttaacccgggaacgggtaaccggttaaccggggttagttaacttaacgtttaccggtaggttaacgggaaacggaacccggtacccccgtaagtaaacccgg

SEQ ID NO: 430889 - DNA, 604 bp, Homo sapiens
  misc_feature: GZ8MTXP02HS50Q.19.71.G05.1.454.CMB.2.raw
  modified_base (245)..(245): a, c, t, g, unknown or other
  modified_base (492)..(492): a, c, t, g, unknown or other
  modified_base (508)..(508): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtctccagacctccctggctgtgtctcgtgggcgaggcgggccaccatcaactgacaagtccagccactaattctttanacacgttaccaaataatagaaaactacttagtcttaggaccagcaagacgaccaggacacgccctacgtaggctcgcttactaatttacgtgggactacgtccgtaacccgggaagtccccggggtacccctagaccgtattccgagtcggcgagggtccgggtactaggggaccaggtactttcgacctactaccaacctatacacgctacgccgtgacgagggtacagtaaaggcttggtaggtnttaagttttatacttntaacctaaatattaatttataagtacgttcggtacgtacggttcgacgtaaggaccagggtacatagaacgaacgtacgtacgtgtacgctacgac

SEQ ID NO: 430890 - DNA, 596 bp, Homo sapiens
  misc_feature: GZ8MTXP02I4YGV.19.71.G05.1.454.CMB.2.raw
  modified_base (241)..(241): a, c, t, g, unknown or other
  modified_base (321)..(321): a, c, t, g, unknown or other
  modified_base (373)..(373): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccactaattcttttanacagttccaaacaatgaaaactactagcttggtaccagcagacgaccaaggacagcctcctaggctagctacatttacgnggactacgtcgtacccggagtcccgggtcccctgaccgattacgagtcggcngggtcggtctgggacagtatttcgactctacaccatcacgcacgtccctagaccagggacctagaaaagtagtggtcgggtacttaaggttttatttacgttacgttaccaaaagttaattaattacttattacgtttccggtaggtaccggtttacggaccgtaaacgggaccgtaaggtacgtagtacgtcgaaggactaacgtgtacggacttacgaacc

SEQ ID NO: 430891 - DNA, 556 bp, Homo sapiens
  misc_feature: GZ8MTXP02GRH33.19.71.G05.1.454.CMB.2.raw
  modified_base (381)..(381): a, c, t, g, unknown or other
  modified_base (444)..(444): a, c, t, g, unknown or other
  modified_base (472)..(472): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagacgtcgctagcgacagtgttgcttggcacgtgggtcaggcacgtcccagtcgagtaggtctagagtggcgtagggaacgactagtactttcagtcgtaccacgacggtaggaaataacgtaaatttanacgaccaacctattcctggttagaggtagttcgactagaaccaagtacgaacgtagacctaanagtacgaacgaacctaggtaccctaccnggacagtctacgtcctcgtacgtcgacctacccggagacgtcgggtatacgtatcgtaggacgaacggccgaccctagtacgac

SEQ ID NO: 430892 - DNA, 637 bp, Homo sapiens
  misc_feature: GZ8MTXP02JRDSC.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatcgtccggggacagacgtcgctagcgacagtgttgcgttggctacgtgggtcaggcacgtccccatcgagaggtctagagtggcgtaggggaacgtactattatttcgattcgtaccaacgtacggtaggaaaataacgtaaatttacgtcgacaacctaattcgtaggttagagtacgtaccgtacgtacgaacaactacgtaaaacgtacgaacaacgtacgtaacggaaacgtaaaccctacggtttaccctacccgtcgacgacgtaccgtacgtaacccgttcgtacgtacgtaacccgtacccgggtaacgggtaaccgtacggggttacgttaacgttaacgtttacggtaggtacgggtaacggacccggtacccccgtaagtaaccg

SEQ ID NO: 430893 - DNA, 587 bp, Homo sapiens
  misc_feature: GZ8MTXP02HNXNG.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagacgtcgctagcgacagtgttgcttggcacgtgggtcaggcacgtccccagtcgaggtaggtctaaggagtggcgtaggggaaaggtacattatttcgagttcgtaccaaacgacgtaggaaataactaaattatcgacctaccatcgtagtagagtagtcactagacaaatacaaacgtagaccaatatacgaaacgaacctacgttactccctagcaacgtctacgtaccctcgtcgttacgacccgttacccggaacggtaccgaccgggttagtaacgttaacgttacgttacgggtacgggaaacgacccgggaccccctaagtaaccg

SEQ ID NO: 430894 - DNA, 656 bp, Homo sapiens
  misc_feature: GZ8MTXP02JMTFG.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacaggacgtcgctagcgactaggttgttgcgttggctacggtcgggtacacggcacgtccccagtcggaggtacggtctaaggaggtggcgtaggggaaagtactattactttcagttcgtaccaaacgtacggtaaggtaaactaaacgtaaatttatacgactaacctagttcgttaggttagaacgtagttaccgaacgttacggaaactaacgtaaccgtaaaacgtaacgaaactaaccgtaagttaaaccggaaacgtaaacccttaacggttccctacccgtaggactacgtaccgtacgtaacccttcgtacgtaccgtaccggtacccggaaggtacccgtacggggttattacgtaagttacggtaggtacggaacgacggtacccagtaacg

SEQ ID NO: 430895 - DNA, 705 bp, Homo sapiens
  misc_feature: GZ8MTXP02FR6BJ.19.71.G05.1.454.CMB.2.raw
  modified_base (246)..(246): a, c, t, g, unknown or other
  modified_base (357)..(357): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgagcgggccaccatcaactgacaagtccagccaactaattcttttaanactacgttacccaaaacaataagtaaaaacttacttaagctttagggaacccagaccaaggaacgaaccaggaaccacgtccctaccgtaggcctcgctactaatttacgngggacctacgtaccggtaaaccccggggaacgttccccccggggtaccctacggaccgtagttccgaggtcggcgacggcggggttcgtacgggactagtactttaccacttctaccacactacagacacggtcctaggaccgaggtactaaggaaagtgttggtaggtactttaaggttttattaggttactaaacctaaaagttaaatttaagtttaaattttaacgttaaccgttcggggttacggtaccgggtttaccggaaaccggtaaaacggggtaaccgtaaggggttaggtaaacttaagtacggaacggtaaacgtacggtttaggcggttacctacg

SEQ ID NO: 430896 - DNA, 652 bp, Homo sapiens
  misc_feature: GZ8MTXP02HB074.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacttgtcgccacgtccgtccggggacaggacgtcgctagcgacgtagtgttgcttggctacgtgggtcacggccacgtccccagtccggagtacggtctaggaggtcggacgtaggggaagactagttactttacagtcgtccaaacgtacgtaggaaactaacgtaaattatacgaccactatcgtagttagagtagtacgactagaactaatacgaaacgtacgaaacacgtaagtaacgaaacgtaacctacgtttacctaccccgtagaccgacgtacgtacgtaaccctcgttacggtaccgacccggttacccggaacgggtaccggtaacggggttacgttaaacgttaacggtttaaacgtacgggttaacgggaaaaccggtaccccggtaacccccgtaagtaaacccgg

SEQ ID NO: 430897 - DNA, 221 bp, Homo sapiens
  misc_feature: GZ8MTXP02H8ICP.19.71.G05.1.454.CMB.2.raw
  modified_base (216)..(221): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactcctggctgtgtctcgtgggcaggcggctggcaaggcgcatagnnnnnn

SEQ ID NO: 430898 - DNA, 587 bp, Homo sapiens
  misc_feature: GZ8MTXP02JYCKO.19.71.G05.1.454.CMB.2.raw
  modified_base (237)..(237): a, c, t, g, unknown or other
  modified_base (249)..(249): a, c, t, g, unknown or other
  modified_base (302)..(302): a, c, t, g, unknown or other
  modified_base (310)..(310): a, c, t, g, unknown or other
  modified_base (341)..(341): a, c, t, g, unknown or other
  modified_base (345)..(345): a, c, t, g, unknown or other
  modified_base (350)..(350): a, c, t, g, unknown or other
  modified_base (357)..(357): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtcagccacaatctttanacagttccaaanaatagaaaactctagcttgaccagcagagaccaggacagcctctaggctgctnatttacgngcatccgtaccggacgtccggtcccagactntcgngcgcnggcggtnggatagtacttcactcctacacatacacgacgacgccgcgacgacgtacgtagaagtagtaggtagtacgttagtttaagttattacgtaactaaacttaaattaattaattaacgttacgttacggttacggtacggttacggtaaccggaaacggtaaacggtaaacggtaacggtaacgtaacgtaacgtaacgtaacggtaacgtacggtacggtacgtacgtacg

SEQ ID NO: 430899 - DNA, 651 bp, Homo sapiens
  misc_feature: GZ8MTXP02HJ0X1.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcaacgaccctctcgcctcacctgtcgcccatcgtccggggacaggacgtcgctagcgactaggttgttgcgtttggctacggtgggtacacgggccacgtccccagtccggaggtaggtactaggaggtgggacgtaggggaagactattacgtttcacgttacgtaccaaacgtacggttaaggtaaaacttaacgtaaaagttactacggaccctaactaagttcgttaggttacgaagtacgtccgtaacgtagaaactaagtacaaacggtaagaaccaacgtaaagtaaccgaaaacgtaaccctacgtttaccctaccgtaggactacgtcgtacgtacccttgtacggtaccgtaccgtaccggaacggtacgtaacgggttataacgttaagtacgtaggaacggaacgtaccggaccctagtaaccg

SEQ ID NO: 430900 - DNA, 657 bp, Homo sapiens
  misc_feature: GZ8MTXP02IOLHN.19.71.G05.1.454.CMB.2.raw
  modified_base (245)..(245): a, c, t, g, unknown or other
  modified_base (261)..(261): a, c, t, g, unknown or other
  modified_base (292)..(292): a, c, t, g, unknown or other
  modified_base (297)..(297): a, c, t, g, unknown or other
  modified_base (299)..(299): a, c, t, g, unknown or other
  modified_base (320)..(320): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggctacgactacgactgactaagtccagccactaattctttanactagttcaacattanaaaactcttagcttggaccagcagacgaccnggacncncctctagctgctctattacgnggactacgtaccggtaaccggtacgtcccccggggtacctacgtaccgtagttcggacggttcggcggtacgggtccgggttacggtacgggactacggttactttccgaccttccacctactacgtacgtacgacgacgtacgtacgacgacgacgtacgtaagtacgtacggtacgtacgttacgtttagttacgttacgttaactaaacgttaacttaatttaacttaacgttacgtttacggtacggttacggttacggtaacggtaaacggtaacgtaacggtaagtaacgtaacgtaacgtaacggtaacgtacgtacgtacgtacgtacg

SEQ ID NO: 430901 - DNA, 530 bp, Homo sapiens
  misc_feature: GZ8MTXP02GMRHS.19.71.G05.1.454.CMB.2.raw
  modified_base (347)..(347): a, c, t, g, unknown or other
  modified_base (364)..(364): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctagagtggctggggaagacatatttcatgtccaanacgtgaatacaaattangacaccatctgttgagtagtcgactagacaatacaaacgtagaacacatacgaaacgaacctacgttcctaccctgcacgctcgtacctcgtcgtcgaccgtcccggacggaccgtacgggtagtactaagttacgtaggtacggaacggacggaccccagtaacg

SEQ ID NO: 430902 - DNA, 604 bp, Homo sapiens
  misc_feature: GZ8MTXP02G1T95.19.71.G05.1.454.CMB.2.raw
  modified_base (245)..(245): a, c, t, g, unknown or other
  modified_base (330)..(330): a, c, t, g, unknown or other
  modified_base (372)..(372): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaagtccagccactaattctttanactagttacccaaactaatagaaaacctcttagcttaggaccagcagacgaccagacacgcctcgtaggctgcctacatttacgnggactagtccgtaacccgggatcccccggggtcctgaccgtnttcgaggttggccgacggtcgggtctcgggactaaggtctttccacttcgaccacactcagctacgctgacaggtctagaagtctggtgacttagtttatagttcgtaacaaacttatatttaatactacgtttacggtcggtacgttaccggaccgtaaacgggtaccgtaaaaggttcggtaaattaagtacgtaacggtaaacgtaacgttacggtcggtacgtaaccg

SEQ ID NO: 430903 - DNA, 533 bp, Homo sapiens
  misc_feature: GZ8MTXP02IT7JM.19.71.G05.1.454.CMB.2.raw
  modified_base (224)..(224): a, c, t, g, unknown or other
  modified_base (234)..(234): a, c, t, g, unknown or other
  modified_base (246)..(246): a, c, t, g, unknown or other
  modified_base (351)..(351): a, c, t, g, unknown or other
  modified_base (359)..(359): a, c, t, g, unknown or other
  modified_base (388)..(388): a, c, t, g, unknown or other
  modified_base (413)..(413): a, c, t, g, unknown or other
  modified_base (434)..(434): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttanacagttccaaanaatgaaaactacttagcttggtaccagcagagacaggacagcctcaggctgctcatttactggcatctacccgggaatccggggtcccctgaccgatcgagtgcnggcgggtntcgggacagtactttcactctccacatcngcagacctgcagctagaacgattgnggtctaggtttattagttgtnaaactaattattatttatacttcgtaggtaccgttacggacctaaaggggactaacgggtagacttagtaaccgagaaccgtatggtacggcttagacc

SEQ ID NO: 430904 - DNA, 550 bp, Homo sapiens
  misc_feature: GZ8MTXP02FKZSN.19.71.G05.1.454.CMB.2.raw
  modified_base (311)..(311): a, c, t, g, unknown or other
  modified_base (318)..(318): a, c, t, g, unknown or other
  modified_base (361)..(361): a, c, t, g, unknown or other
  modified_base (409)..(409): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgacaagtccagccacaatcttttatacagttaccaacaatagaaaactacttagcttaggtaccagcaagagaccaggacagcctccaggctgctnatttacnggcatctacccggatccggggtcccctgacctattcagtggcngggcgggtcgtagggacagtactttcactctcaccactacagcagccngcgagcgagaagagtggtgattagtttaattatacgtaactaaactaaattaattaattacttacgtacggtacggtacgtacggacgaaacgggacgtaaggtacgtatagtaacgaacgaacgacgtgtcgactacgac

SEQ ID NO: 430905 - DNA, 639 bp, Homo sapiens
  misc_feature: GZ8MTXP02HKNN0.19.71.G05.1.454.CMB.2.raw
  modified_base (248)..(248): a, c, t, g, unknown or other
  modified_base (330)..(330): a, c, t, g, unknown or other
  modified_base (425)..(425): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtggggcgaggccgggccaccgatacgaactgacaagtccagccacaattcttttanactagttaccaaacaatagaaaactcttagcttggaccagcagacgaccaggacacgcctcctaggctgctcatttacgggngctacgtaccgtaccgggacgtccgggtccctcgacctattcgaggtcggcgcgggtcgggtataggggactagttacttccactctacacctancgacgcacgtctgacgaggtacgtagaaacgtgttcggtaggttacgtttaagtttacgttaagttacgtaaactaaattaagtttactttaatttaacgttacgttacggttacggtaaccggttaccggaacggtaaacggtaacggtaaggttacgtaacttacggaaccgtaaaggtaaccggttacgtcggtacggtaccgtacgtacc

SEQ ID NO: 430906 - DNA, 609 bp, Homo sapiens
  misc_feature: GZ8MTXP02IZP3R.19.71.G05.1.454.CMB.2.raw
  modified_base (248)..(248): a, c, t, g, unknown or other
  modified_base (320)..(320): a, c, t, g, unknown or other
  modified_base (370)..(370): a, c, t, g, unknown or other
  modified_base (378)..(378): a, c, t, g, unknown or other
  modified_base (404)..(404): a, c, t, g, unknown or other
  modified_base (410)..(410): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggccaccatcaactgacaagtccagaccaactaattcttttaanactagttaccaaacaataacgaaaactacttagcttaggaccagacagacacgagacagcctcaggctgctntatttacgggcagtcctaccgggatccgggccctgaccgtatcgagtgcngggcggtnagggacagtacttcactctcaacctnacgacncgacgtcagacgagacgagaagtagtcggtagttattaagtttattacgtaacgtaactaaagttaatttaaatttaacgtttacttaccgtttacggtacggttaccggttacgggaaaccggtaaacggggtaacgtaagggtacgtaagtaacgtaacgtaaaggtaacgtacggtacgtacggtacgtacgtacg

SEQ ID NO: 430907 - DNA, 629 bp, Homo sapiens
  misc_feature: GZ8MTXP02IBOPQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccctatccgtccggggacagacgtcgctagcacagtgtgcttggctacgtggtcaggcacgtccccagtcgagagtctagagtggcgtgggaagacgtatattcagttcgtaccaaacgtacgtaggaaataacgtaaattatacgaccctaaccattcgttagttaggaagtagtacggaacttaggaaacctaataacgaaaacgttacgaaccaactaacgttaacgaaacgaaacccgttaagttccctaacccgtgactaacgcttaccggaaccctttcacggttacgaccccgttacccgggaacgtaaccggtaccggggttattaaacgtaacgtttaccgtaggaacgggaaccggtacccggaacccccttaagaaaccg

SEQ ID NO: 430908 - DNA, 669 bp, Homo sapiens
  misc_feature: GZ8MTXP02JPI0G.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccactccgtccggggacagacgtcgctagcgacaggtgttgcgttggctacgtgggtcaggcacgtccccagtccggagtaggtctagaggtggcgtaggggaagtactattacttcgatacgtaccaaacgtacggtaggaaattaactaaaagtttactacgacctaacctaagttccgttaggttaggaacgtacgtccgtaaacgtagaaactaaacgtacgtaaaacgtacgaaacaacgtaacgttaaccggaaaacgtaaacccgttacgtttcccctacccgtaggaaccgtacgtacccgtacgtaaaccccgttcgtacggtaccgtaaccccggtaccgggaacgggtaaccgtaccggggttataaacgttgttaccggtagggtaacggaaccgtacccgtaccccgtaaataaccgg

SEQ ID NO: 430909 - DNA, 622 bp, Homo sapiens
  misc_feature: GZ8MTXP02JJYRI.19.71.G05.1.454.CMB.2.raw
  modified_base (237)..(237): a, c, t, g, unknown or other
  modified_base (380)..(380): a, c, t, g, unknown or other
  modified_base (445)..(445): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttaccaacaatagaaaactactagcttggaccagcagacgaccaggacagcctaccgtaggctgctacattttacgcggactactaccgtaaccccggggaattcccggggtacccccctgaccgtattcgagtcggcngggtcgggtcgtagggaccagtatttccactctcacccatcagcagcctgcacggctagaaagtntaggtcggtacttaagtttattagttgaacctaaattaaattagtttaattagtttaaaccgttcgggtaacggttaccggtttacggggaaaccgtaaaacggggtacccgtaaaggggtagtaacgtagtaacgaacggtaaaccgtaacggtggtttaaccggcgttacgaacc

SEQ ID NO: 430910 - DNA, 634 bp, Homo sapiens
  misc_feature: GZ8MTXP02IOKT4.19.71.G05.1.454.CMB.2.raw
  modified_base (240)..(240): a, c, t, g, unknown or other
  modified_base (270)..(270): a, c, t, g, unknown or other
  modified_base (313)..(313): a, c, t, g, unknown or other
  modified_base (321)..(321): a, c, t, g, unknown or other
  modified_base (401)..(401): a, c, t, g, unknown or other
  modified_base (427)..(427): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggccacatcaactgcaagtccagccaacaattctttanacagttccaaacaatacgaaaactacttancttaggtaccagcagagaccaggacagcctacgtaggctgctnatttacgnggcatcgtacccgggatccccggggcctagaccgtattcagtcgcgagcgggtctgggactagtacttcgacttcacacntcagcacgcctgccaggcagaaacgngtgtagggatttaaggtttaattagttacgtactaaaactaaatttaactttaatttaacttaaccgtttacggtaggttaaacccgggttttaccggaaacccgtaaaacgggggtaacccgtaaaacggggtacgggttaaagttaaacgttacggaaaaccggtaaaccggtaaacggtttacggtcggggttacttaacccgg

SEQ ID NO: 430911 - DNA, 633 bp, Homo sapiens
  misc_feature: GZ8MTXP02GWQ4S.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccggggacagacgtcgctagcgacagtgtgcttggcacgtgggtcaggcacgtccccagtccgaggaggtctagaggtggcgtaggggaagactattattcagttcgtaccaaacgtacggtaggaaacttaactaaagttatacgaccacctattcgtaggttagagtagttcgaacttagaactaactacgaaacgtacgaaccaactaacgtacggaaacgtaaccctagtttacccacccgttagacctacggacctacggtaacccttcgtacggtacgtaccccggttacccgggaacggtaacccggttacgggtacgttaacgttaacgttaccggtaggttaacgggaaacgtacccgggtaccccctaaagtaaaccgg

SEQ ID NO: 430912 - DNA, 614 bp, Homo sapiens
  misc_feature: GZ8MTXP02H8VOC.19.71.G05.1.454.CMB.2.raw
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccctagtccgtccggggacaggacgtcgctacgcgaactgtgtgcttggcacgtggtcaggcacgtccccatcgagtacggtctaaggagtcggacgtaggggaagactatagttttcagttcgtaccaaacgacgttagaaatacgtaaattacagaccactattcgtagttaggacgtacgttccgaagtagaaacctataccgaaacgggtacaactaacggtactacggaaaacgtaaccctagtttaacccctcgtacgactacgtacctaccgtacttcgtacggtaccgaaccgtaaccggacggtaaccgtacggttattaaacgttaacgttacgaacggtaacggaaccgtaccgtaacctaagtaccg

SEQ ID NO: 430913 - DNA, 645 bp, Homo sapiens
  misc_feature: GZ8MTXP02GJUSW.19.71.G05.1.454.CMB.2.raw
  modified_base (237)..(237): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcnccatccgtccggggacagacgtcgctagcgacagtgtgcttggcacgtgggtcaggcacgtcccatcgagtaggtcgtagacgtggcgtagggaacgactattacttcatcgtacacgacgtaggtaaataactaaattatgacctaacctagttcgtggttaggaacgtagtacgacgttagaactaataccaaacggttaagaaacctaacgaaacgtaaccggtaaaacgtaaacccgtacggtttacccctaccgtagaccgtaacggtacctacgggtacccttcgttacggaccggttacccgtaccccggaagggtaaccggtacgggggttaattacgttaacgtttaaccggtagggtacgggtaaaaccgcccggtaacccctagttaaccggaaccg

SEQ ID NO: 430914 - DNA, 527 bp, Homo sapiens
  misc_feature: GZ8MTXP02GKGV9.19.71.G05.1.454.CMB.2.raw
  modified_base (239)..(239): a, c, t, g, unknown or other
  modified_base (361)..(361): a, c, t, g, unknown or other
  modified_base (403)..(403): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatctttanacagttccaacaatagaaaactcttagcttggtaccagcaagagaccaggacagcctcctaggctgctcatttactggctatcgacccgggaatccggggtcccctgaccgattcagtggcngcgggtctgggacagtatttcactctcaaccatcagcagccncgcgagagagagagtgtagtgtagttattatagtataataatattattatacttacgtacgtacgtacgtacgacggacgacgtacgtagtataacgacgaacgtacgtagtacgcgtacgacg

SEQ ID NO: 430915 - DNA, 612 bp, Homo sapiens
  misc_feature: GZ8MTXP02HTER1.19.71.G05.1.454.CMB.2.raw
  modified_base (238)..(238): a, c, t, g, unknown or other
  modified_base (249)..(249): a, c, t, g, unknown or other
  modified_base (302)..(302): a, c, t, g, unknown or other
  modified_base (311)..(311): a, c, t, g, unknown or other
  modified_base (359)..(359): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccaggggacatcgtgatgacccagtctccagactccctggctgtgtctcgtgggcgagccgggccacgatacgaactgacaagtccagccacattctttanacagttccaanaatgaaaactctagcttagaccagcagagaccagacagcctcgtagctagctntatttacgngctagtaccgaccggtacgtccggtccacgaccgtatcgaggtgacgngggtccggtcgacggtaactagttaccttccacttccaccaacgtatacgacgctaaccgtcgcgacgacgacgtagtaagtagtagtaggtacgttagtttagtttagttagttaacgtaaattaaattaatttaattaagttacgttacgttacggttacggttaccggtaaccggtaaacggtaacggtaacggtacgtacgtaacgtacgtaacgtaacgtaacgtacgtacgtacgtacgtacgtacg

SEQ ID NO: 430916 - DNA, 637 bp, Homo sapiens
  misc_feature: GZ8MTXP02GHFDQ.19.71.G05.1.454.CMB.2.raw
  modified_base (243)..(243): a, c, t, g, unknown or other
  modified_base (252)..(252): a, c, t, g, unknown or other
  modified_base (254)..(254): a, c, t, g, unknown or other
  modified_base (256)..(256): a, c, t, g, unknown or other
  modified_base (261)..(261): a, c, t, g, unknown or other
  modified_base (264)..(264): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacgatacgactgactaagtccagcacaatctttanacatacaanananaactntanctcgacagacagacgacgagacacgtcctacgagctgactactactttacgcggactacgtaccggtaaccgggtacgttccggggtacccctacgaccgtataccggacgtacggtacgcgggtcgggtcggtacgggacgtacgtacttactactactaccaccactacgacgacgacgccgtcgacgacgacgtagagtagtggtacggttagttagtttagtttacgttacgtaacgtaaacttaattaatttatttaacgttacgttacgttacggttaccggttaccggtaccggtaaacggtaacggtaacggtacgtagtacgtaacgtaacgtaacgtaacgtacggtacggtacgtacgtacg

SEQ ID NO: 430917 - DNA, 720 bp, Homo sapiens
  misc_feature: GZ8MTXP02IQWZU.19.71.G05.1.454.CMB.2.raw
  modified_base (658)..(658): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtagaacgccctcgcagacccctctcgcctccacctgtcgccagtccgtccggggacagacgtccgctagcgactagtgttcgcgttggcacgtgggtcacggccacgtccccagtcgagtacggtctaggagtggacgtaggggaagtactattattcactcgtaccgaaacgtacggtaagtaaacttaaactaaaagtttacgtacgacctaaccctaacgtttacgttagggttacggtaacgggtaacgtacccggtaaacgttacggtaaaacctaaacgttaaccgtaaaaccggttaacgaaaacctaacggtaaacgttaaaccggaaaaccgtaaaacccgttaccgtttaccccgtaccccgttagaccgtaacgtccgtaccgtaacccgttcgttacggtaccggtacccgttacccggaacggtaccggttaaccggggttntttaaacgtaacgtttaacggttaggtaacggtaaacgacccggtaacccctaaggtaaccg

SEQ ID NO: 430918 - DNA, 576 bp, Homo sapiens
  misc_feature: GZ8MTXP02G85Z7.19.71.G05.1.454.CMB.2.raw
  modified_base (249)..(249): a, c, t, g, unknown or other
  modified_base (273)..(273): a, c, t, g, unknown or other
  modified_base (328)..(328): a, c, t, g, unknown or other
  modified_base (364)..(364): a, c, t, g, unknown or other
  modified_base (368)..(368): a, c, t, g, unknown or other
  modified_base (376)..(376): a, c, t, g, unknown or other
  modified_base (409)..(409): a, c, t, g, unknown or other
  modified_base (413)..(413): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgaggccgggccaccgatacaactgacaagtccagaccactaattcttttanacagttccaaataatagaaaactnttagcttggtaccagcagagaccaggacagcctcctaggctagctacatttacgnggcactcgtacccgggatccgggcccctgacccgtntcgnggtcgcgngggcggtgaggactagtacttcactctacacancgancgacgcgcgacgtagacgtagagtgtggtagtattagtttatagtacgtactaattattattattacgttacgtacggtacggtacgttacggaacggtaacggtaacgtaggtacgtaactaacgtaacgaacgtaacgtacgtggtacgtacgtacgtacc

SEQ ID NO: 430919 - DNA, 635 bp, Homo sapiens
  misc_feature: GZ8MTXP02HUMK6.19.71.G05.1.454.CMB.2.raw
  modified_base (73)..(73): a, c, t, g, unknown or other
  modified_base (236)..(236): a, c, t, g, unknown or other
  modified_base (332)..(332): a, c, t, g, unknown or other
  modified_base (434)..(434): a, c, t, g, unknown or other
tcagtactctcgtgcacgaccggtgctcgatttagtgtcgtcgcaagagagaggggggtacaacaggcaggcnggggcagcaagatggtgttgcagacccaggtcttcatttctctgttgctctggatctctggtgcccgacggggacatcgtgatcgacccagtctcagacctccctggctgtgtctcgtgggcgagcggcacgatcaatgcaagtcagaccacaattctttaanactagttaccaaactaatagaaaacttactagcgttaggaaccagcagaagacccaaggactagccctacgtaggctacgctactagtttaccggnggtactacgtaccggtaaccggtacgtcccgggtcctaccgaccgtacgtcgaggtcggcgagggtcggtacgacggactagtacttcgactcctacactanacgacgcacgtcgagacgacgtacgtagaacgtagtgtaggttacgtttagtttaactacgttactaacgtaaaattaacttaattaacgtttacttacgtttacggtaccggttacggtaccggtaacggaaacggacggttaaggtacgtaacgtacgacgtaacggtaacgtaacgttcggacgtactacgtactacg

SEQ ID NO: 430920 - DNA, 596 bp, Homo sapiens
  misc_feature: GZ8MTXP02GUTVK.19.71.G05.1.454.CMB.2.raw
  modified_base (260)..(260): a, c, t, g, unknown or other
  modified_base (325)..(325): a, c, t, g, unknown or other
  modified_base (386)..(386): a, c, t, g, unknown or other
  modified_base (421)..(421): a, c, t, g, unknown or other
  modified_base (429)..(429): a, c, t, g, unknown or other
  modified_base (484)..(484): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccgggccaccataccaactgacaacgtccagccaataattctttaacagttaccaanaatagaaactctagcttaggaccagcagacgaccagacacgcctcgtaggctgctatatttacgnggctacgtccgtaacccggggacgtcccggggtacccctagacccgtattcgaggtgacgngggtccggtgtcgggactagtactttccacgttcnccacctanacgacgcgacgccgtagacgacggtacagagtgtgtacgtattagtttatagtanaactaattattattattacgttacgttacggtacggtacggtaccgaacggtaaacggtacgaggtacgtaatacgaacgaacgtaacgtacgtaggtacgtacgtacgacc

SEQ ID NO: 430921 - DNA, 662 bp, Homo sapiens
  misc_feature: GZ8MTXP02IES4A.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttctcctgccgtgctggcctccacaaggtgtcctgtcacaagtacagctgcagcagtcaggtccaggactggtgaacgccctcgacacgaccctctcgctcacctgtcgccacgtcgaccggggacagacgtcgctagcgacgtagtgttgtcgttggcacggtggtcgaggcacgtaccccagtacggagtaggtctaggagtcggcgtaggggaagtacgtattagttcagtcgtaccaaacgtagtaagtaaactaaacttaaagttatacgaccaacctattacgttagttagaaggtacgtacgtaaccgtagaaaactaaacgttaaccgaaaaggtaacgaacaaactaacgtaacgaaaacgtaacctacgttaccctaccgttacggactaacgtccgttacgaaccttcgtcggttaaccgtacccgtacccgggaacggtaacccgtacgggttaagttaagttaacgttaccggttaagggtaacgggaaaccggacccgttaacccccggtaaaagtaaccg

SEQ ID NO: 430922 - DNA, 599 bp, Homo sapiens
  misc_feature: GZ8MTXP02FLJGU.19.71.G05.1.454.CMB.2.raw
  modified_base (240)..(240): a, c, t, g, unknown or other
  modified_base (463)..(463): a, c, t, g, unknown or other
  modified_base (572)..(572): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccaacaattctttanactagttccaaacaatagaaaactacttagcttggaccagcagagaccaggacacgcctctaggctgctactatttacggggacctacgtccgtacccggggtaatcccgggggtccccctgaacccgatttcgaggtcggcgcggcggggtctaggggactacgtatttccacttctaccacccatacgagaccacgccctgccgagggacctagaaacgtntggtaggattaaggtttattatacgtaactaaactaaatttatttaattattacgttacggttacggtaccgttacggaccgtaaagggaccgtaagggtcgaattacncgaagacgtaacgtgtcggactcgacc

SEQ ID NO: 430923 - DNA, 654 bp, Homo sapiens
  misc_feature: GZ8MTXP02JQX63.19.71.G05.1.454.CMB.2.raw
  modified_base (247)..(247): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatacaactgacaacgtccagccaactaattcttttanactacgttaccaaacaatagaaaactacttagtcgttaggtaccagacaagacgaccgaggacagcctcctaggctggctacgtactttacgtgggctacgttccgtaaccccggggtaacgttcccggggtacccccctagaccgtaacttccgaggtcggacgtggggccggggttcagggggacaggttactttaccacttcctacctaaccactacgacgccgacgccgtgcgacggctagaaagtgtggtagtacttaggttttattagttcgtaaactaactaaattatttaagttattacgtacgttacggtaccggttcggaaccgtaaacgggacgtaacggggttagaacgttacgaacgtaaacggtaccgtaacgtgtaccgtagtcgtaacccg

SEQ ID NO: 430924 - DNA, 532 bp, Homo sapiens
  misc_feature: GZ8MTXP02G2MKE.19.71.G05.1.454.CMB.2.raw
  modified_base (342)..(342): a, c, t, g, unknown or other
  modified_base (435)..(435): a, c, t, g, unknown or other
  modified_base (458)..(458): a, c, t, g, unknown or other
  modified_base (489)..(489): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcacgtggtcaggcagtccccatcgagagtcagacgtggctggggaaggacagtatttcaagtcgtaccaacacgtggaactacaaattangacaccatctagttgacgagtcgactagacaaagtcaaacgtagaacacaatacgaaagaaccagttcctaccctgactagctgacctctagnaaccgtccgaggacaacgggttntaatatacgtagaggaacgaccgaccctaanacgactacgcgaaccctacctcgtctcgtcggtactacgtacg

SEQ ID NO: 430925 - DNA, 674 bp, Homo sapiens
  misc_feature: GZ8MTXP02HG0EG.19.71.G05.1.454.CMB.2.raw
  modified_base (243)..(243): a, c, t, g, unknown or other
  modified_base (255)..(255): a, c, t, g, unknown or other
  modified_base (327)..(327): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgatacgaactgactaagtccagccataatcttttaanacagtaccaaanaataagaaactactagctagacagacagacgaccaggacacgtcctacgaggtctgtactactaatttacgnggactactaccggtaacccggggaacgtcccggggtacccctacgaacccgtattacgaggtcggacgcggtcgggtacggtacgggtacgacgtacgttactactacctacctacctactacgacgacgtacgtaccgtacgacgacggacgtaagaagtagtaggtacgtacgtaacgtttaagttagttacgtaacgtaaactaaattaacttaaacttaacgttaacgttacggttacggtacggttaccggtaaccggtaaacggtaaaccggtaaacggtaacggtaacgtaacgtaacgtaaacgtaaacgtaacgtacggtacggtacggtacgtaccg

SEQ ID NO: 430926 - DNA, 681 bp, Homo sapiens
  misc_feature: GZ8MTXP02GLZ6X.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtccggggacagagtcgctagcgactagtgttgcgttggctacgtgggtacacggccacgtccccagtccgaggaggtctagaggtggacgtaggggaaaggactagttactttcagttcgtaccaaacgtacggtaggaaacttaacgtaaaagtttactacgacctaacctaacttcgtagttaggaagtacgtaccgtaacgtacgaactaaacgtaacgtaaacgtaacgaacaactaacgtacggaaacgtaaccgtacgttacccgttaccgtacgtacgtaacgtccgtacgtaccctacggttacgtaccggtacccgtacccgggtaacgggtaacccggtaaccggggttaagttaacgttaaccgtttaacggtacgggttaacgggaaaccggtacccggtaacccccgtaagttaaacccgg

SEQ ID NO: 430927 - DNA, 529 bp, Homo sapiens
  misc_feature: GZ8MTXP02I9B3D.19.71.G05.1.454.CMB.2.raw
  modified_base (398)..(398): a, c, t, g, unknown or other
tcagtactctcgtggcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatatttcatgtaccaacacgtggaatacaattatgcaccatctgtgagagtcgatgacaatcaaacgtagacacatcgaaagaacctagttccnccctgacacgctagacctctgtcgactcccggaggacgacgggtctagtacttacgtagtaggaaacgcggtacccccaagtacgaccacttaacccaaccttcggtactcgtggtacgtcttagttacgg

SEQ ID NO: 430928 - DNA, 583 bp, Homo sapiens
  misc_feature: GZ8MTXP02H1JMP.19.71.G05.1.454.CMB.2.raw
  modified_base (448)..(448): a, c, t, g, unknown or other
  modified_base (458)..(458): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcacgacccctctcgctcaccctgtcgcccagtccgtccggggacagacgtcgctagcgacagtgttgcttggcacgtgggtcaggccacgtccccagtcgaggaggtctagaggtggctaggggaagactattatttcaattcgtaccaaacgtacggtaggtaaactaacaaaatttatacgaccaccattctgttagaagtagttacgactagaaccaatcaaacggtaanaacaacgtanacgaaacgacctacgttcctcctgacagtctacgaccttcgtcgtacgaccgtaccggaacgtaccgacggttataacgttaacgttacggtacggtacggaacggaccgtacccgtaagtaacg

SEQ ID NO: 430929 - DNA, 614 bp, Homo sapiens
  misc_feature: GZ8MTXP02I9AYO.19.71.G05.1.454.CMB.2.raw
  modified_base (243)..(243): a, c, t, g, unknown or other
  modified_base (382)..(382): a, c, t, g, unknown or other
  modified_base (393)..(393): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcgaactgacaagtccagccaactaattctttanactagttaccaaactaatagaaaaactacttagcttggtaaccagcaagacgaaccaggacacgcctaccgtaggctgctctaatttacgggacctaactccgtaacccggggaatcccggggtccccctagacccgtnttcaggtggcngggccggtctggggacctagtactttcactctcaccatcgagcagccctgcaggtctagaaagtgtgtacggacttaggtttaattaagttcgtaataaactaaattaatttattaaacttcgttacggtacgggtacgtttccgggaaccgtaaagggggtaaccagggttaacgaacttagaaccgtaaggaaccgtaacgtcggtacggctacgaacc

SEQ ID NO: 430930 - DNA, 626 bp, Homo sapiens
  misc_feature: GZ8MTXP02JPNZW.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcacgaccctctcgctcacctgtcgccatccgtccggggacagacgtcgctagcgacagtgtgcttggctacgtgggtcaggcacgtccccagtcgagacggtctaggagtggcgtaggggaaggactaattactttcagttcgtacccaaacgtaacggtaggtaaactaacgtaaaatttatacgacctacctaattccgttaggttagaaggtacgttacgaactacggaaacaacgttaacgaaaaccggttagaaacaactacgtaacgaaacgtaacctaacgttcctacccgtacgacaacgtctacgtaccttcgtcgtacgaccgtaccggacggtaccgacgggttgtaaacgttaacgttacgtacgggtacggaacgtacccggaccccgtaagtaaccg

SEQ ID NO: 430931 - DNA, 595 bp, Homo sapiens
  misc_feature: GZ8MTXP02FSA1G.19.71.G05.1.454.CMB.2.raw
  modified_base (330)..(330): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagagtcgctagcgacagtgttgcttggcacgtggtcaggcacgtccccatcgagaggtctagagtggcgtgggaaggacagttatttcatcgtaccaanacgtaggaactaacaaattatgacaccatctgttagagagtcactgacaatacgaaacgtagaacacatacgaaacgaactacgttacctaccctgacctacgtctacggacccttcgtacggtacgtaacccgtcccggaaggtaccggtacggggttagtaacgttaacgttaccgttaggttacgggaaacggtaccggaccccctaaagtacgaccagttccgaaccctaccgtcgttctcgtcggtacgtactttaacgg

SEQ ID NO: 430932 - DNA, 567 bp, Homo sapiens
  misc_feature: GZ8MTXP02IFYXC.19.71.G05.1.454.CMB.2.raw
  modified_base (239)..(239): a, c, t, g, unknown or other
  modified_base (251)..(251): a, c, t, g, unknown or other
  modified_base (302)..(302): a, c, t, g, unknown or other
  modified_base (310)..(310): a, c, t, g, unknown or other
  modified_base (360)..(360): a, c, t, g, unknown or other
  modified_base (526)..(526): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcaactgacaagtccagccactaatctttanacagttaccaanaatagaaaactctagcttggtacagcagacgacagacagcctcagctgctntatttacnggacatccgtaaccggagtcccgggtccccagaccgtattccaggtcgcnggtcgggtactgggacctagtactttcactctcacatcagcagctgacgagctagaagacgttggtgtactagttttatattacgaactaactaattatttagttactacgttcgtaggtacgtttacgggaccctaaaagggaacctaagggtaggtaattacgngtaaacggaacgtaacgtgggttacggacttacggaacccg

SEQ ID NO: 430933 - DNA, 595 bp, Homo sapiens
  misc_feature: GZ8MTXP02GUXMW.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctaggagtggcgtaggggaaggactatatttcattcgtccaaacgacggtaggaaataacaaattatacgacactatctagttgaagtagtcgactagaacaatacgaaacgtagaacacgagtacgaaacgaaccgtagttaccctacccgtgaccagtacctacgtacccttcgtacggtaccgacccgttaccccgggaaggtaccggtacggggttgttaacgttaacgtttaaccgtaggttaacgggaaacgtacccgggaccccctaaagtaaccgg

SEQ ID NO: 430934 - DNA, 661 bp, Homo sapiens
  misc_feature: GZ8MTXP02HHT43.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcacgtggtcaggcacgtccccatcgagaggtctaggagtggcgtagggaagacattatttcagttcgtaccaaacgtacggtagaaactactaaaattatacgactacccgtaattccgttgtttagaaaggtacgttacgaacgtagaaacctaaagtaccgaaacgttaacgaaaccgacgtaaacttaaccggaaacgtaaaacccgttaacgtttcccctaccccgttacgacgtaacgtccgttacgtaccctttcgtacgttacgaaccgttcccggaggaaccgtacggggttattaagttacgttacgttaggtgggtaaacgacccggaccccgaagtaacggacctacgtacggaacccctaccgtccgttactccgttcggtcgtaccgtttaacgg

SEQ ID NO: 430935 - DNA, 695 bp, Homo sapiens
  misc_feature: GZ8MTXP02JKU1O.19.71.G05.1.454.CMB.2.raw
  modified_base (316)..(316): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcgttggctacgtgggtcaggcacgtccccagtcgagagtctagngtggcgtagggaacgactagtatttcagttcgtaccacgtacgtaggaaacttaacaaagttactacgaccaacctattcttaggttacgagtagttacgacctagaactaaataccgaaacgtacgaactaacgtaagtaccgaaaacgtaaccgtacgttacccgtaccccgtagtacccgtaaacgtcccttaccgggtaacccttacggtacggttaccgaaacccccggttaccccggggaaacgggtacccgggttaaaccgggggtttacgttaaacgttttaaaaccgttaaccgggttaacggggttaaacggggaaaaccggggtacccccggttaccccccgtaaaacggtttaaccgaaaacccggg

SEQ ID NO: 430936 - DNA, 592 bp, Homo sapiens
  misc_feature: GZ8MTXP02HRL00.19.71.G05.1.454.CMB.2.raw
  modified_base (243)..(243): a, c, t, g, unknown or other
  modified_base (259)..(259): a, c, t, g, unknown or other
  modified_base (265)..(265): a, c, t, g, unknown or other
  modified_base (312)..(312): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagccgggccacgatacgaactgacaagtccagccactaatctttaanactataccaataatanaaactntagctgacagacagacgacagacacgcctcgagctgctctattacgnggtacacgtaccgtaaccggtacgtccgggtacctacgacgtatcgaggtgacgaggtcgggtcgtaggactagtacttcgactcacacactacacgacgacgcgtcgcgacgacgtagagagtgtacgtagttagtttattagttagtactaactaattaattaattaacgttacgttacggttacggtacggttacggtaacggtaacggtaacggtaacggtacgtacgtaacgtacgtaacgtaacgtaacgtacgtacgtacgtacgtacgtacg

SEQ ID NO: 430937 - DNA, 609 bp, Homo sapiens
  misc_feature: GZ8MTXP02G49EK.19.71.G05.1.454.CMB.2.raw
  modified_base (247)..(247): a, c, t, g, unknown or other
  modified_base (328)..(328): a, c, t, g, unknown or other
  modified_base (387)..(387): a, c, t, g, unknown or other
  modified_base (435)..(435): a, c, t, g, unknown or other
  modified_base (448)..(448): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccgatacgaacgtgacaagtccagccactaattctttanacagttaccaaacaatagaaactacttagcttaggaccagcagacgaccaggacagcctccgtaggctgactcatttacgnggacactaccgtacccggggaagttcccggggaccccctgaccgtattcgaggtcggcngggcgggtcgtacggggactaggtactttccaacttctaccaacctanacagccacgtccngacgagtactaggaatgtggtagtattagttttatagttacgtaactaaacttaattaatttattacgttacgttcggtacggtacggttacggaaccgtaaacgggtacgtagggtactagtaacgtaacgaacgtaacgtacgtggtacgactacgacc

SEQ ID NO: 430938 - DNA, 603 bp, Homo sapiens
  misc_feature: GZ8MTXP02JI1SU.19.71.G05.1.454.CMB.2.raw
  modified_base (239)..(239): a, c, t, g, unknown or other
  modified_base (322)..(322): a, c, t, g, unknown or other
  modified_base (435)..(435): a, c, t, g, unknown or other
  modified_base (465)..(465): a, c, t, g, unknown or other
tcagtactctcgtgcacgaccggtgctcgatttagtgtcgtcgcaagagagagggggggtacaacaggcaggcatgggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccacaattcttttanacagttaccaaacaatagaaaactacttagcttaggtaccagcagagaccaggacagcctcctaggctgctactattttacgnggggctacgtaccgtaccccggggaaagtccccggggtaccccctggaaccccgatttccgagtcggacagggtcgggtcgtaggggacaggtactttcgaactctacactancgagcacgccctgaccagggctagaaagtntggtaggcttaaggtttattatgtactaaataattagttattacgtaacgttcgtacggtacgttcggacccgtaaagggtacctaaggggttacgtaatacgtaacgaagaaccgtaacgtgtaggcctaggaaccc

SEQ ID NO: 430939 - DNA, 564 bp, Homo sapiens
  misc_feature: GZ8MTXP02FQZ9B.19.71.G05.1.454.CMB.2.raw
  modified_base (205)..(205): a, c, t, g, unknown or other
  modified_base (310)..(310): a, c, t, g, unknown or other
  modified_base (319)..(319): a, c, t, g, unknown or other
  modified_base (351)..(351): a, c, t, g, unknown or other
  modified_base (413)..(413): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaacgccctgcagaccctctcgctcacctgtcgccatccgtccggggacagagtcgctagcgacagtgttgcttggcacgtgggtcaggcacgtccccagtcgagnggtctaagngtggctgggaagacatatttcagtcgtccaanacggtagaatactaaattatgacacctatctgttagagagtcgactagacaatcaaaggtanacaacataccgaaacgaacctacgttacctccctgaaccacgtacgtacgtaccgtcgtacgtaccgtaccgtaccggaacggtacgtacgggttacgttaacgttaacgttaacgtacggtacggaacgaccggtaacccgtaagtaacg

SEQ ID NO: 430940 - DNA, 670 bp, Homo sapiens
  misc_feature: GZ8MTXP02JPFKB.19.71.G05.1.454.CMB.2.raw
  modified_base (249)..(249): a, c, t, g, unknown or other
  modified_base (396)..(396): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagccggccaccatcaactgacaacgtccagaccaactaattcttttaanactacgttaccaaactaatacgaaaactactagcttaggaccagcagacgacagacacgcctcaggctgctactatttacgcggactacgtacccgtaacccggggtacgtcccgggtacccctacggacctatcgaggtcggacgngggtcgggtcgagggactagttactttaccacttcctaccaccgtactacgacgtaccgacgcccgtagccgaaggtacgtaaggaaacgtggttacggtagtacgtttaagttttacgtttaagtacgtaactaaaacttaatttaatttaactttaacgttacgttacggttacgggtaaccgtttaccgggaaaccggtaaacgggtaacgtaacgggtacgtaacgtaacgtaacgtaacgtaaacgtacgtggtccgtagtcgtaaccc

SEQ ID NO: 430941 - DNA, 633 bp, Homo sapiens
  misc_feature: GZ8MTXP02GMXZY.19.71.G05.1.454.CMB.2.raw
  modified_base (246)..(246): a, c, t, g, unknown or other
  modified_base (338)..(338): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacgaacgtgacaagtccagccactaattctttaanactacgtaccaactaatagaaactacgtagtcgttacgaccagacaagacgaccgagacacgtcctacgtaggctgctactaacgtttacgngggactacgtacccggtaacccggggtaacgttcccggggtacccctacgaccgtattcgaggtcggcgtcgggccgggtcgtagggacctagtactttccaccttcctaccacctactcgacgcacgtcctagacgaggactagaagtagtggtagtacttagtttattagttacgtaactaaattattaacttagttacttacgttcggtacggtacgtacggaacgtaaacggtacgtaagggtacgtaagtacgtaacgtaacgtaacgtaacgtggtacgtacgtacgac

SEQ ID NO: 430942 - DNA, 760 bp, Homo sapiens
  misc_feature: GZ8MTXP02HXGPG.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtaccggggacaggacgtccgcgtaggccgactagtcgttgcgtttggcctacgttgggtacagggccacgtccccagttccggaaggtacggttacctaaggtaggtgggaccgttaggggaaacggtactagttaacttttcgaacgttcgtacccgaaacgtaccggttaaggaaaacttaaacgtaaaatttagtacgaacctaacctaagttccgttggtttagaaaggttacgttaccgaacgttaacggaaacctaaacgtaccgtaaaaaccggttacgaaaacctaaacgtaaacgttaacccggaaaaacggtaaaaccccttaaggtttacccctacccgttacgacccgtaacggtaccctaacgtaaccccgtttgtacggttaccgtaacccgttacccgggaaacgggtacccgtaacgggggtttacttaaacgtttaaccgtttaaggtacgggttaaacgggaaacggtaccccggtaccccttaaaggtaacccg

SEQ ID NO: 430943 - DNA, 604 bp, Homo sapiens
  misc_feature: GZ8MTXP02JR8IV.19.71.G05.1.454.CMB.2.raw
  modified_base (321)..(321): a, c, t, g, unknown or other
  modified_base (388)..(388): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccactcgtccggggacagagtcgctagcgacagtgtgcttggcacgtgggtcaggccacgtccccagtcgagacggtctagngtggcgtagggaagtactagttattcagttcgtaccaaacacggtaggaaataacctaaaatttacncgacctaaccattcgttgtagagagtacgactagaacaataccgtaaacgaacgtacaacgacgttaacgaaaacgtaacctaacgttccctacccgtacgactacggtacctacgtacccgtcgtacggtacgacccgtacccgggaaggtaccgtaacgggttacgtaagttaacgttaacgtacgtacgggaacgacgtaccccgagtaaccg

SEQ ID NO: 430944 - DNA, 593 bp, Homo sapiens
  misc_feature: GZ8MTXP02GNTH4.19.71.G05.1.454.CMB.2.raw
  modified_base (237)..(237): a, c, t, g, unknown or other
  modified_base (250)..(250): a, c, t, g, unknown or other
  modified_base (260)..(260): a, c, t, g, unknown or other
  modified_base (312)..(312): a, c, t, g, unknown or other
  modified_base (412)..(412): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccacaatctttaanactacgtaccaanatagaaactntagctagtacagcagacgaccgagacacgcctcgtagctgctactattacgnggactacgtaccgtaaccggggtacgtcccgggtacctacgaccgtatcgaggtcggacgagggtcggggtctaggggacagtacttcactctacactanacacgacacgcgtcgacgacgacgagagtagtagtacggtacgttagtttagttagttacgtactaactaattaattaacttacttacgttacgtacggtacggtacggtacgtaacggtacggtaacggtacgtacgtacgtacgaacgtacgtacgtacgtacgtacgtacgacgtacg

SEQ ID NO: 430945 - DNA, 710 bp, Homo sapiens
  misc_feature: GZ8MTXP02HOB0Y.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgccctcgcacgaccctctcgctcacctgtcgccatctccggggacagagtcgctagcgacagtgttgcttggcacgtggtcaggcacgtccccagtcgaggaggtctagaggtgggcgtaggggaacggactattactttcattcgtacccaaacgtacggtaggtaaaacttaactaaaatttatacgaccaaacctattcgttagggtttaggaacggtaaggttaccggtaaacgtttacggaaacctaaaacgttaccgtaaaaccggtaaacgtaaaccgaaaccgtaacgttaaaccggaaaacgtaaacccgtaacgtttaccctacccgttacgaccaaggtcccgtacgtaaccccttccgttacggtaccggtaacccgttaccccgggaaaggggtaaccccgtaacgggggttaacgttaaacgttaacggtttaacgtacggggttaacggaaaaccgggtacccggtaacccccgaaagttaaacccgg

SEQ ID NO: 430946 - DNA, 613 bp, Homo sapiens
  misc_feature: GZ8MTXP02JAQC9.19.71.G05.1.454.CMB.2.raw
  modified_base (245)..(245): a, c, t, g, unknown or other
  modified_base (257)..(257): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggcctacgatacgacgtgactaagtccagccacaatctttaanactacgtacaanatacgtaaactactagcgttacgacagacagacgacgagacacgcctcgagctgctctacttacgtcggcgtacgtaccgtaccggtacgtccggtccccgtacgacgtacgtacgtacgtcgcgcggtcgggtcggtacggacgtacgtacgttactactacctacctactactacgacgacgacgtcgtcgacgacgacgtacgagtagtagtacgtacgttagttattagttacgtacgtaactaattattattacttacgttacggtacggtacggtacggtacggtaacggtaacggtacggtacgtacgtacgtaacgtacgtacgtacgtacgtacgtacgtacgtacg

SEQ ID NO: 430947 - DNA, 616 bp, Homo sapiens
  misc_feature: GZ8MTXP02HQM59.19.71.G05.1.454.CMB.2.raw
  modified_base (230)..(230): a, c, t, g, unknown or other
  modified_base (242)..(242): a, c, t, g, unknown or other
  modified_base (254)..(254): a, c, t, g, unknown or other
  modified_base (264)..(264): a, c, t, g, unknown or other
  modified_base (267)..(267): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccgatcaactgcaagtccagccanaattcttttaanactactaccaanatacaaactntanctagacagacagacacgagacacgtcctctagctacgctactacttacgtcggactacgtaccgtaccggtaccggtccggtccccgtacgacgtacgtacgtaggtcggtcgcggtcgggtcggtacggtacgtagtacgttactactcctaccacctactacacgacgacgtccgtcgacgacgacgtacgagtagtaggtacgtagttagttattattacgtaactaaactaattaattaattacgttacgttacggttacggtacggtacggtaacggtaaacggtaacggtaacggtacgtaagtacgtaacgacgaacgtacgtacgtacgtacgtacgtacg

SEQ ID NO: 430948 - DNA, 677 bp, Homo sapiens
  misc_feature: GZ8MTXP02HFAOV.19.71.G05.1.454.CMB.2.raw
  modified_base (244)..(244): a, c, t, g, unknown or other
  modified_base (479)..(479): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgacaagtccagccactaattctttanacagttaccaacatagaaaactactagcttggacagcagagaccaggacacgcctcgtagctgctactatttacgtgggacctacgtacccgtaccccggggaaacgttccccggggtccccctacggaacccgtactttcgaaggtcgaaccgcggggtccgggggttactcggggaaccgtagttaactttcctaacctcctaccaaccctactcgaacgccgtacggtcccncgaccgaggacgtaagggaaacgtgttacgggtaggtacgtttaagttttacgttaattacgtaaactaaacttaaagtttaatttaagtttaacgttacgttacggtacggttacgttaccggaaccggtaaacgggacgtaacggtacgtaattaacgaacgtaaacgacggtacgtacggtcgtacgtacgaccg

SEQ ID NO: 430949 - DNA, 592 bp, Homo sapiens
  misc_feature: GZ8MTXP02FH003.19.71.G05.1.454.CMB.2.raw
  modified_base (235)..(235): a, c, t, g, unknown or other
  modified_base (246)..(246): a, c, t, g, unknown or other
  modified_base (310)..(310): a, c, t, g, unknown or other
  modified_base (402)..(402): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctggcgagccgggccacatcaactgcaagtccagccacaatcttttanacagttccaanaatgaaaactactagcttggtaccagcagagaccaggacagcctcctaggctgctcatttacgnggacacgtcgtaccggagtccgggtccacgaccgtatcgagtcgcaggcggtcgaggacagtacttcactctacactatacacgacgacgcncgacgacgacgtagaagtagtagtaggtacgttagtttatttagttacgtaactaaactaaattaaatttaattaacttacgttacgtacggtacggtaccggtaaccggaaacggtaaacggtaaacggtaacggtaacgtaacgtacgtaacgtaacgtaacgtacggtacggtacgtacgacgtacg

SEQ ID NO: 430950 - DNA, 667 bp, Homo sapiens
  misc_feature: GZ8MTXP02HW89V.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccactccgtccggggacagagtcgctagcgacagtgtgcttggctacgtggtcaggcacgtccccatcgaggtagtctagaggtggcgtaggggaaggactattatttcagttcgacctaaacgacggtaggtaaaactaactaaaagttatacgaccaccctaaattccgtaggttacgaggtagtcgtaactagaaacctagtacctaaaggtacaaacacgtaagtacggaaactaaacccgtagttaacccctccgtacgactaaccggtccgttaccaacccgtttcgtacgggttacccgaaacccgttacccccggggaaagggtaaccccgttaacgggggtttacttaaagtttaaccggttaaccggtttagggaaaccggtaaaacgggaccccctacccccggtaaaagtaaaccgg

SEQ ID NO: 430951 - DNA, 628 bp, Homo sapiens
  misc_feature: GZ8MTXP02FTIMS.19.71.G05.1.454.CMB.2.raw
  modified_base (310)..(310): a, c, t, g, unknown or other
  modified_base (388)..(388): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagtgttgcttggcacgtggtcaggcacgtccccatcgagnggtctagagtggcgaggggaagactagttatttcagttcgtcccaaacgacggtagggtaaaactaactaaaatttanacgacctaccgtattcgttagttaggaagtacggtaccgtaacgttacggaacctaaaacgtcaaaacggttaacaaccaaacagttaacccgaaaacgggtaaaccctacggtttaccctccccggttagaccacggtacctacggacccttcgtgtacgacccgttacccggacggtaccgtacggggtattaacgttaagttacggtagtacgggaacgtaccggacccagtaaccg

SEQ ID NO: 430952 - DNA, 703 bp, Homo sapiens
  misc_feature: GZ8MTXP02G3NN2.19.71.G05.1.454.CMB.2.raw
  modified_base (240)..(240): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaaactgcaagtccagccacaatcttttanacagttaccaacaatagaaaactcttagcttaggtaccagcagagaccaggacagcctcctaggctgctcatttacngggcagtccgtacccgggaatccggggtcccctgacctattccgagtggcagggcgggtactggggacagtactttcactctccaaccatcagcacgcccgtgaccgagggacctaggaaacgtacgttgggtacgggtactttaaagggtttttaacgtttaatttacggttaaccgaaaaacctttaaaagtttaaactttttaaacgtttaaatttaaaaccggtttttcccgggttaaaggggtttaaaaccccggttttccgggggaaacccgttaaaaacgggggaaccccgttaaaagggggttacgggtaaacttaagttaacccgaaaaggtaaaccggtaaaaccgttgggttaaccggctttaacggaaaccccg

SEQ ID NO: 430953 - DNA, 663 bp, Homo sapiens
  misc_feature: GZ8MTXP02FZSL5.19.71.G05.1.454.CMB.2.raw
  modified_base (239)..(239): a, c, t, g, unknown or other
  modified_base (249)..(249): a, c, t, g, unknown or other
  modified_base (254)..(254): a, c, t, g, unknown or other
  modified_base (263)..(263): a, c, t, g, unknown or other
  modified_base (311)..(311): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtggcgagcggccaccatcaactgcaagtccagccaacaattctttaanactatacaanaatanaaactatancttagacagcagacgacagacacgcctcgagctgctactactttacgnggactacgtaccgtaaccggtacgtcccgggtacccctacgaccgtattcgaggtcggacgtcgggtccgggtcgtagggactacgttactttaccaccttcctaccaacctactacgacgtaccgacgccgtagaccgaggacgtagaaaggtgttcggtacggtatttaagttttaattagttactaaactaaacttaaatttaaatttaagttaacgtttacgttacggttaacgggttacccggttaccgggaaaccggtaaaacggggtaaccggtaaaagggttaacggtaacttaaacgtaacgtaaacggtaaaccggtaacgtcggtacggacctacggaacc

SEQ ID NO: 430954 - DNA, 594 bp, Homo sapiens
  misc_feature: GZ8MTXP02F2M5M.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagacgtcgctagcgacagtgttgcttggcacgtggtcaggcacgtccccatcggagaggtctaggagtggcgtaggggaaagactattatttcagttcgtaccaaacgacggtaggaaactaacgtaaaatttagtacgaccacctatcgttagttagaagtacgtcgactagaactaaactacgtaaacgtacgaacaactaagtaccgaaacgtaacctacgttcctacctgacacgtctacgtaccttcgtacgtacgaccgtacccggaacggtaccgtacgggtagttaacgtaacgttacgtaggtacggaacgaccggacccctaagtaaccg

SEQ ID NO: 430955 - DNA, 594 bp, Homo sapiens
  misc_feature: GZ8MTXP02F460M.19.71.G05.1.454.CMB.2.raw
  modified_base (383)..(383): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactgggtgaacgccctcgccacgacccctctcgctcacctgtcgccatccgtccggggacaggagtcgctagcgacagtgtgcgttggctacgtggggtcaggccacgtccccagtcggagaggtcgtaggagtggcgtaggggaacgactatatttcatcgtacacgacgtaggaaatacaaattntacgcactatctgttgagtagtcgactagaactagtacaaacggtacaactacgaactaacgaaacgtaaacccgttagttcccctaccgtagactacggctacgtacctcgttacggtacgacccgtacccgggaaaggtacggtaacggggttatacgttacgttaacgtacggtacggaacggtacccggacccctaagtaccgaacg

SEQ ID NO: 430956 - DNA, 592 bp, Homo sapiens
  misc_feature: GZ8MTXP02GBRL2.19.71.G05.1.454.CMB.2.raw
  modified_base (309)..(309): a, c, t, g, unknown or other
  modified_base (316)..(316): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctccgctcacctgtcgccatcgtccggggacagacgtcgctagcgacagtgttgcttggcacgtgggtcaggcacgtcccatcgagnggtcagngtgcgtgggaacgactagtatttcatcgtaccacgacgtaggaaatacaaatttagcgacactatcttgtagagtagtacgactagaacatacaacgtagaacaacacgtacgaaacgaaaccgtagttccctaccgtagtacgaacgtctacgtaccttacgtcgtacggaccgttacccggaaacggtaacgtaccggggttacgttaactttaagttaaccggttagggtaacggaaacggacccggaacccccggtaataaccggtaaaccg

SEQ ID NO: 430957 - DNA, 629 bp, Homo sapiens
  misc_feature: GZ8MTXP02FSYK9.19.71.G05.1.454.CMB.2.raw
  modified_base (238)..(238): a, c, t, g, unknown or other
  modified_base (314)..(314): a, c, t, g, unknown or other
  modified_base (323)..(323): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggcgggccacatcaactgacaagtccagccactaattctttanacagttaccaaacaatagaaaactactttaagcgtttaggacccagcaagacgaccaggacagcctcgagctgctntaatttcgnggacctatccgtaaccggactccgggtccctcgaccgagttacaggtcggacgtcggcggtcggtacggacgagtacgtttctacctctacacccatacacgacacgtcctacgacggacgacgtagaaaggtagtaggttaggtacgttagtttaagtttattacgttaacaaactttaaataattttattaactttacgttaccggtaggttaacccggttacggtaacccgtaaaaggggaaaccgtaagggtacggtaattagaaccgtaagtaacgaacgtagtacggcgtacgtaacccg

SEQ ID NO: 430958 - DNA, 525 bp, Homo sapiens
  misc_feature: GZ8MTXP02FNI2F.19.71.G05.1.454.CMB.2.raw
  modified_base (317)..(317): a, c, t, g, unknown or other
  modified_base (380)..(380): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactggtcaggcagtccccatcgagaggtctagagtggctggaagacatattcatgtaccaanacgtggaactacaaattatgcaccatctgttgagagtcgactgaacaatacaaacgtagacanatacgaagaaccagttccaccctagcagctacgacctctgtacgacctcccggagacgacgggtatatagttacgtgtaggaagacggaccccaatacgaacattaccgaacctaccgtcgtacctcgttggtacgtctttaacg

SEQ ID NO: 430959 - DNA, 636 bp, Homo sapiens
  misc_feature: GZ8MTXP02HSUQX.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgccagaccctctcgctcacctgtgccatcgtccggggacagacgtcgctagcgacagtgttgcttggcacgtgggtcaggcacgtccccatcgaggaggtctagagtggcgtgggaagacattattcatgtccaaacgtacgtagaataacgaaatttatacgaccaactacgttcgttagtttagaagtacggtacgtaacgttacggaactaaacttaccgaaaaccggttaacgaaaccaacgaaagttaccggaaaaacgaaacccgtaacggttacccttacccccgttaggccaaacggtcgtaccgtaacccttcgttacggttacgaccccgttacccgggtacggaaccgtaccgggggttagtacttaacgttacgtagggtacggaaacgaaccggaccccctaaagtaacg

SEQ ID NO: 430960 - DNA, 635 bp, Homo sapiens
  misc_feature: GZ8MTXP02JISBQ.19.71.G05.1.454.CMB.2.raw
  modified_base (394)..(394): a, c, t, g, unknown or other
  modified_base (442)..(442): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacgaactcgacaagtccagccaactaattcttttatacacgttaccaaactaatacgaaaactacttacgcttaggtaccagacaagacgacgaggacagcctcgtaggctgctctattacgtgggctatccgtaaccggagtcccggggtcctcgaccgtatcaggtcgacgcggcggggtcnggggaactacgtatttaccacctctaccaacgtactagaacggtaccncgtcgacgcgacgtacgtagaagtagtagtacgtacgttagttattacgttacgtaactaaactaattaactttaacttaacttacgttacggtacggtacggtacggtaacggtaacggtaaacggtaacggtacgtaacgtaacgtaacgtaacgtaacgtaacgtacggtacggtacgtacgtacgtacg

SEQ ID NO: 430961 - DNA, 613 bp, Homo sapiens
  misc_feature: GZ8MTXP02J34FZ.19.71.G05.1.454.CMB.2.raw
  modified_base (245)..(245): a, c, t, g, unknown or other
  modified_base (368)..(368): a, c, t, g, unknown or other
  modified_base (374)..(374): a, c, t, g, unknown or other
  modified_base (412)..(412): a, c, t, g, unknown or other
  modified_base (431)..(431): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcctggctgtgtctcgtggcgagccggaccacatcaactgacagtccagaccactaattcttttanactattaccaaacatacgaaactctagcttaggaccagcagacgaccaggacacgcctcgtaggctgctactattacgcggactacgtccgtaaccgggacgtcccggggtcccagtaccgtnttacgnggtcggcgtcgggcgggttacaggactagtctttaccncctcaccacactcgacgcncgccagacgaggtcagagtgtggttagttactttaagtttaacttacgtactaaacttaaattaagttttaactttaacttacggttacgggttcggttacggtaaccggtacggaaacggtaaacggtacgtaggtaactacgtacgaacggtaaacgtacgtacgtcggacgtactacac

SEQ ID NO: 430962 - DNA, 569 bp, Homo sapiens
  misc_feature: GZ8MTXP02GBV6U.19.71.G05.1.454.CMB.2.raw
  modified_base (285)..(285): a, c, t, g, unknown or other
  modified_base (330)..(330): a, c, t, g, unknown or other
  modified_base (406)..(406): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgactagtgttgcttggcacgtgggtcaggcacgtccccatcgagnggtctagagtggcgtaggggaagactattatttcattcgaccaanacggtaggaaactaacaaattatcgacacctatcgtgttacgagtacgtacgatgaacaaatcaaacgtagaacanatacgaacgtaacctagttctaccctgacagtcctacgaccctgtcggtacgaccgtaccggaaggtacgtacgggttattaagttacgtacgtagtacggaaacgccggtaccccagtacgactacgtcgaacctacgtcgtctcgtcgtcgtactttacgg

SEQ ID NO: 430963 - DNA, 646 bp, Homo sapiens
  misc_feature: GZ8MTXP02H9D3F.19.71.G05.1.454.CMB.2.raw
  modified_base (248)..(248): a, c, t, g, unknown or other
  modified_base (295)..(295): a, c, t, g, unknown or other
  modified_base (322)..(322): a, c, t, g, unknown or other
  modified_base (399)..(399): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactgggtgaagccctcgcagacccctctcgctcacctgtcgccatccgtccggggacagagtcgctagcgangtgtgctggcacgtggtcaggcacgtccccagtcgagaggtctaggnggtggcgtaggggaggactattatttnatgtaccgaaacacggtggaaataactaaaattatcgacaaccattccgtggtttagaacggtagtacgtacgtaanaaactaactaacgtaaacgtacgaacaacaacgtaacggaaacgtaaaccgtacgttccctaccgtacgactacgtaccgtacgtaccttcgtacggtaccgtaccgtacccggaacgggtaccgtacgggttagttaacgttaacgtttacggtacggtacggaacggacccgtacccgtaagtacgtactacgtacccgtaacccgtaccgttaccgtcgttacggttcggtacgttacgtacgg

SEQ ID NO: 430964 - DNA, 605 bp, Homo sapiens
  misc_feature: GZ8MTXP02JVNUJ.19.71.G05.1.454.CMB.2.raw
  modified_base (232)..(232): a, c, t, g, unknown or other
  modified_base (240)..(240): a, c, t, g, unknown or other
  modified_base (251)..(251): a, c, t, g, unknown or other
  modified_base (305)..(305): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccgatacaactgcaagtccagccanatctttanacagttccaanatgaaactactagctgacagcagagacagacagcctcgagctgctcatttacgnggactacgtaccgtacccggacgtcccgggtacccctacgaccgtattcgaggtcggacgcggggtcgggtcgtagggactagtactttcactctaccacactcacgcacgccgtgacgagctaggaaggtgtggtacgtacttaagttttattacgttacgtaactaaaacttaatttaatttaagttaagttaccgtttacggttcggtaccggttaccggaacccggtaaagggtaaccgtaagggtacgtaattaacgaacgtaaacgtaacgtacgtggtacgtccgtacgaccg

SEQ ID NO: 430965 - DNA, 662 bp, Homo sapiens
  misc_feature: GZ8MTXP02JGESK.19.71.G05.1.454.CMB.2.raw
  modified_base (337)..(337): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccgacggggacatcgtgatgacccagtctccagacctcctggctgtgtctcgtggcgagcggccacatcaactgacaagtccagccactaattctttatactagttacccaaactaatacgaaaactacttaagtcttacggtaccagcaagacgaaccaggaccagtccctcgtaggctgtctactatttacgnggctacgtccgtacccgggaacgtcccccccggggtacctggtaccctagttcgacgttcggcgacgggtcgggtacgtagggacaggtactttccactccgtacctacgactcgagactacggcctgaccgaggtctaggaaagtcggttagtagggtacctttaggttttattacggttactaactaaaacttattaatttaacgtttattaaccgtttcggtagggtacctttaccggggaaccgttaaaacgggacccgtttaaaggaggtaactaacggtaacgtaaccggaacggttaacgttcggtacggtactaccg

SEQ ID NO: 430966 - DNA, 514 bp, Homo sapiens
  misc_feature: GZ8MTXP02H6V4U.19.71.G05.1.454.CMB.2.raw
  modified_base (227)..(227): a, c, t, g, unknown or other
  modified_base (411)..(411): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctggggcagcgggccaccatcaactgacaagtccagccanaattctttatacagttccaacaatagaaactactagcttgtaccagcagacgacaggacagcctctaggctgctcatttactgggcagtctacccgggatccggggtcctgaccgtatcagtgcagcgggtctagggacagtattcactctcacatcagcagcctgcaggctagagatgtggtntagtttatatatactaataattattaattatacgtacgtacgtacgtacggacgtaacggacgtaagtacgatacacgaagacgtacgtgtacgctcgacacg

SEQ ID NO: 430967 - DNA, 617 bp, Homo sapiens
  misc_feature: GZ8MTXP02IWJLD.19.71.G05.1.454.CMB.2.raw
  modified_base (246)..(246): a, c, t, g, unknown or other
  modified_base (335)..(335): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcctggctgtgtctcgtgggcgaggcgggccaccatacaactgacaagtccagccaactaattcttttanactagttacccaaacaatacgtaaaactacttagcttaggaccagcagacgaccaggacacgcctcgtaggctcgctactattttacgngggactacgtccgtaaccccggggtaagtccccggggtacccctaggaacccgtattaccgaggtcgggaccgtgggtcggggtctagggggaacctaggtactttccgacctctaccaacctatcgagtcacgccctagcaggcagaaagtcgttggtaggtacttaggttttatagttacgtactaaataattaattattattacgtcgtaggtaccgttacggacgaaacgggtacgtaggtacgattagaacgaagaaccgacgtggacgctacgacc

SEQ ID NO: 430968 - DNA, 676 bp, Homo sapiens
  misc_feature: GZ8MTXP02GOIMR.19.71.G05.1.454.CMB.2.raw
  modified_base (307)..(307): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccggggacagagtcgctagcgacagtgtgcttggcacgtggtcaggccagtccccagtcgagnggtcagagtggcgtaggggaaggactattacgtttcagttcgtaccaaacgtacggtaggaaaacttaacgtaaaatttagtacgaacctaaccctaagttccgttaggttaggaagtaacggttacgaaccttacggaaaactaaacttaccgaaaaccggttagaaacctaacgaactaaccggaaaacgtaaaccccgtaacgttttcccgtaccccgttagaccgtaacggtcccttacggtaccccttacgtcggtaccgtaacccgttaccccgggaaaggacccgtaacggggttactttaaagtaacgtttaacggacggttaacgggtaaccgaacccgggtaccccctaagtaaaccgg

SEQ ID NO: 430969 - DNA, 596 bp, Homo sapiens
  misc_feature: GZ8MTXP02JYRQP.19.71.G05.1.454.CMB.2.raw
  modified_base (417)..(417): a, c, t, g, unknown or other
  modified_base (438)..(438): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacagtgttgcttggcacgtggtcaggcagtccccatcgagaggtctagagtggctggggaaggacatatttcatcgtaccaacgacggtaggaaactacgaaattactagcaaccatcgtagttagagagtcgatgaacaatcaaacgtagacacatacgaagaacctagttccnccctgaccagcctcgaccttntacgtacgaccgtcccggaaggaccgtacggggttagttaattacgttacgtagggttacggaaacgacccgggtaccccctaagtaccggaacctaacgtaccggaacccctaaccgttccggttccttaccggttcggttacgtacgtttaaacgg

SEQ ID NO: 430970 - DNA, 654 bp, Homo sapiens
  misc_feature: GZ8MTXP02HDUBJ.19.71.G05.1.454.CMB.2.raw
  modified_base (384)..(384): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgtgcgttggcacgtgggtcaggcacgtccccagtcgagaggtctaggtagtggcgtaggggaagactagtactttcattcgtaccaacgtacggtaggaaatactaaatttanacgacctactaattcgtaggttacgaagtacgttcgaacttacggaaactaaagtaccaaaacggtacgaaacctaacgaacgttaacggaaaacggtaaaaccctcggtttaaccctcccgtaggacctacggtccgtacgtaaacccgttcggttacggtaccgtaaaccccggttacccgggaaaggaacccggtacgggggtttacttaagttaaccggtttacggtacggtacgggaaacggtacccggacccctaaggtaaccg

SEQ ID NO: 430971 - DNA, 596 bp, Homo sapiens
  misc_feature: GZ8MTXP02F5NUB.19.71.G05.1.454.CMB.2.raw
  modified_base (227)..(227): a, c, t, g, unknown or other
  modified_base (245)..(245): a, c, t, g, unknown or other
  modified_base (275)..(275): a, c, t, g, unknown or other
  modified_base (308)..(308): a, c, t, g, unknown or other
  modified_base (351)..(351): a, c, t, g, unknown or other
  modified_base (362)..(362): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcgaactgcaagtccagccanatctttaacagttccaanatagaaaactatagcttagtaccagcaganaccaggacagcctctaggctagctcatttacgngcagtccgaccggagtcccgggtccacgactatgagtggacgngggtcgggtcngggactagtacttacactcctacacctatcgacgcacgtcgtacgcgtacggctagacgtagtggtagtacgttagtttattagttacgtaactaaacgttaaatttaagttaacttacgttacgttacggttacggttaccggttacggaaccgtaaacgggtaaccgtaagggtacgtaacttaacgtacgtaacggtaaacgtacgtacggtacggtcgtacgacgtaacg

SEQ ID NO: 430972 - DNA, 633 bp, Homo sapiens
  misc_feature: GZ8MTXP02H4O48.19.71.G05.1.454.CMB.2.raw
  modified_base (241)..(241): a, c, t, g, unknown or other
  modified_base (251)..(251): a, c, t, g, unknown or other
  modified_base (255)..(255): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacatcaactgacaagtccagccactaatcttttaanactatacaanatanaaactctagctagacagcagacgaccagacacgtcctcgacgctcgctactattacgcggactacgtaccggtaaccgggacgttcccgggtcccctacggtaccgtagtcgaggtcggacgcggggtcgggttacgtacggggactagttactttacactaccacacctatacgacgcacgccgtgacgacgtctaagaagtgtaggtggtacgttaagtttactagttacgaaactaaattaattaatttaacttacgtacgttacggttacgggtaaccggtttaccggaaaccgtaaacggggaacgtaaacgggtcgttaaacgtaacgtaaccgaacggtaaaccgtacgttacggtacgtacgtactaccg

SEQ ID NO: 430973 - DNA, 556 bp, Homo sapiens
  misc_feature: GZ8MTXP02IO1X5.19.71.G05.1.454.CMB.2.raw
  modified_base (322)..(322): a, c, t, g, unknown or other
  modified_base (375)..(375): a, c, t, g, unknown or other
  modified_base (384)..(384): a, c, t, g, unknown or other
  modified_base (415)..(415): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatccgtccggggacagagtcgctagcgacagtgttgcgttggcacgtgggtcaggcacgtccccagtcggagtaggtctagngtggcgtggggaagcattatttcagttgtccaatcgtagaaatactaaattancgacacatntgtgagtatcgactgaacatacgaaacgtanaacaacgtactacgaacgaacctacgttcctacctcgacacgtacgtacgtaccctcgtcgtacgaccgtaccggaacggtaccgtacgggttataacgttaagttaccgtaggtacggaacgtacggacccctagtaacg

SEQ ID NO: 430974 - DNA, 641 bp, Homo sapiens
  misc_feature: GZ8MTXP02H2I07.19.71.G05.1.454.CMB.2.raw
  modified_base (406)..(406): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtgaacgccctcgcacgaccctctcgctcacctgtcgccctagtccgtccggggacaggacgtcgctagcgacgtagttgtgccgtttggctacggtgggtcaggcacgtccccagtcgaggaggtctaggagtggacgtaggggaacgactagttatttcagttcgtaccaaagtacgtaggtaaaactaactaaatttacngaccctaacctattacgttggttacggagtacgttacgaacgtacgaaactacgtaacgaaacgttacgaacctaagtaaagtaaccgaaaacgtacccgttagttacccctacccgttagggaaccctacgtaccgtaccgtaaccccgttgtaccggtacgtacccgttaccgggacggtacgtacgggttataattaacgtcgtaggacggaccgtaccgaccctagaaccg

SEQ ID NO: 430975 - DNA, 570 bp, Homo sapiens
  misc_feature: GZ8MTXP02GHYQL.19.71.G05.1.454.CMB.2.raw
  modified_base (240)..(240): a, c, t, g, unknown or other
  modified_base (377)..(377): a, c, t, g, unknown or other
  modified_base (393)..(393): a, c, t, g, unknown or other
  modified_base (413)..(413): a, c, t, g, unknown or other
  modified_base (530)..(530): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaacaattcttttanacagttccaaacaatagaaaactacttagcttggtaccagcagacgaccaggacagcctcctaggctgctcatttactggctatccgtaacccggggacgtcccggggtccccctagacccgtattcgaggtcggcnggccgggtctgggacngtactttccactctacaccntcagcagcctgacaggctagaagtatggtggacttaagtttattattcgtactaaatattaattattatacgttcgtacggtaccgttacgggaccgtaaacggggacctaaagggngtactaatccgaagaacgtacgtggtcggtactacgtacc

SEQ ID NO: 430976 - DNA, 610 bp, Homo sapiens
  misc_feature: GZ8MTXP02HN7F6.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatcgtcccggggacagacgtcgctagcgacagtgttgcttggcacgtggtcaggcacgtccccagtcgagaggtctaggagtggcgtaggggaaaggactaattacgtttcaagttcgttacccaaaacgtacggtaggaaaattaaaccgtaaaatttatacgaccaaccctattcgtagttagaagtacgtaccgactagaactaaatacaaacgtagaacaactaatacgaaacgaaacctagttccaccctagacaacgctacgtaacctcgtacgtaccgaccgtaccccggaaggaccgtaccggggttagtaattaacgttaaccgtaggtacgggaaacgaccggaccccctaaagtaaccgg

SEQ ID NO: 430977 - DNA, 610 bp, Homo sapiens
  misc_feature: GZ8MTXP02FTFYT.19.71.G05.1.454.CMB.2.raw
  modified_base (229)..(229): a, c, t, g, unknown or other
  modified_base (236)..(236): a, c, t, g, unknown or other
  modified_base (238)..(238): a, c, t, g, unknown or other
  modified_base (245)..(245): a, c, t, g, unknown or other
  modified_base (249)..(249): a, c, t, g, unknown or other
  modified_base (254)..(254): a, c, t, g, unknown or other
  modified_base (257)..(257): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggcctacgatacgactgactaagcagccanatcttananatacaanatanaactntanctagacagacagacgacgagacacgtcctacgagctcgctactacttacgtacgacgtacgtaccgtaccggtaccggtccggtccgtaccgtaccgtacgtacgtacgtcgcgacggtcgggtacgtacggacgtacgtacttactactactactacctactacgacgacgacgtacgtacgacgacgtacgtagtagtagtgtcgtacgttagtttagttagttagtaactaacttaattaacttattacttacgttacgttacggtacgttacggtacggtaacggtaacgtaacggtacgtacgtacgtacgtaacgtaacgtacgtacgtacgtacgtacgacgtacg

SEQ ID NO: 430978 - DNA, 574 bp, Homo sapiens
  misc_feature: GZ8MTXP02GJ1MK.19.71.G05.1.454.CMB.2.raw
  modified_base (242)..(242): a, c, t, g, unknown or other
  modified_base (257)..(257): a, c, t, g, unknown or other
  modified_base (323)..(323): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgacaagtccagccaactaattcttttanactagttacccaaanaatagaaaactacttagcttagtaccagcagagaccaggacagcctactaggctgctctatttcgngggctagtccgtaacccggggaagtccccggggtccctaggacccgtattccgaggtcggcctagggtgggtctggggacagtacttcacttctacaccatcagcagcctgcgagctagaagatgtggcttagtttattagtgtacaaataattattaattagttacttcggtagtacgttacggacgtaaacgggacctaaaggtcgaactagtacgaacgtaacgaacgtggtacggctacgactaacc

SEQ ID NO: 430979 - DNA, 603 bp, Homo sapiens
  misc_feature: GZ8MTXP02I3655.19.71.G05.1.454.CMB.2.raw
  modified_base (451)..(451): a, c, t, g, unknown or other
  modified_base (557)..(557): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgacccctctcgctcacctgtcgccatccgtccggggacagagtcgctagcgacagtgtgcgttggcacgtggtcaggcacgtcccatcgagaggtcagagtggcgtggggaagacatatttacatcgtccaacgtacgtaggaaataacgtaaaatttatacgaccaccgtaattcgttaggttagaagtacgttacgaacttacgaaactaacgttacgaaaaccggttanaaactaacggtaataccgaaaagtaaccctaaggtttcctacccctagacaacggtctacgaccttcgtacgtcgacccgtaccggaaggtacctaacggggtttnattaacgttacgtggtaacggaacgtacccgacccgtaataaccgg

SEQ ID NO: 430980 - DNA, 551 bp, Homo sapiens
  misc_feature: GZ8MTXP02JT2DN.19.71.G05.1.454.CMB.2.raw
  modified_base (229)..(229): a, c, t, g, unknown or other
  modified_base (238)..(238): a, c, t, g, unknown or other
  modified_base (391)..(391): a, c, t, g, unknown or other
  modified_base (414)..(414): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccanaatctttanacagttccaacaatgaaaactactagcttaggtaccagcagagaccaggacagcctcctaggctagctcatttacgtggcatccgtacccgggaatccggggccccctgaccgattcagtgcagcgggtctgggacagatttcactctcaccntcagcagcctgcaggctagaacntgtgctagtttatatgtacaactaattattaatttataacgttcgtacggtacgttcggaccgtaaaggggtaccaaagggtcggtaatagttaaccgaaggaaccgtaaaaccgtggtacggtacgttcggaaccc

SEQ ID NO: 430981 - DNA, 635 bp, Homo sapiens
  misc_feature: GZ8MTXP02GXT6S.19.71.G05.1.454.CMB.2.raw
  modified_base (247)..(247): a, c, t, g, unknown or other
  modified_base (260)..(260): a, c, t, g, unknown or other
  modified_base (326)..(326): a, c, t, g, unknown or other
  modified_base (388)..(388): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccgatacaactgacaagtccagccaataattcttttanactagttaccaanaatagaaaactctagtcttggaccagcagacgaccaggacagcctccgtaggctgctcatttacgngggctacgtaccgtacccggggaactcccggggtacccctgacccgtattccgaggtggacngggcgggtctaggggaccagtactttccactctacaccctagcgaacgcgacgttcccgagccgagggtaccttaggaaagtgttcggtagggtacttaaggtttttaattattacgttaacctaaaattaagtttaatttaaagttacttaacgtttcggtacggtaccgtttacggaacccgtaaagggtaaccgtagggtacgtattacgaacgtacgtaacgtacgtggtacggctacggacc

SEQ ID NO: 430982 - DNA, 640 bp, Homo sapiens
  misc_feature: GZ8MTXP02I6Z1S.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcagaccctctcgctcacctgtcgccacgtcgtccggggacagacgtcgctagcgacagtgttgcgttggctacgtgggtcaggcacgtccccatcgagaggtcaggagtggcgtaggggaacggacattatttcgatcgtaccaacgtacgtaggtaaactaacgtaaattatacgaccactaattcgttagttacgaagtacggttacgacttaggaaaccaaagttacccgaaagttaacgaactaacgtaagtaccgaaaacgtaaccgtacgttccctacccgtagaccgaaggtccttacgacccgttcgttacggtccgtacccgtacccgggaaggtacccgtacgggggttattaacgttaacgtttaacggtacgggtaacgggaaaccgaccgggtaccccctaaggtacgtaaaccg

SEQ ID NO: 430983 - DNA, 587 bp, Homo sapiens
  misc_feature: GZ8MTXP02JSI9P.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcgttggcacgtgggtcaggcacgtccccagtcgagacggtctaagagtggcgtaggggaagacagttactttcagttcgtccaaactacggtagaaatacaaattactgacactatctgttagagtagtacgtactagtaacaatacgaaacgtaagaactaacgtaatacgaaaggtaaccctacggttacctacccgtagaccgaacgtcgtacgaaccttcgttacgtacgtaccggtacccgacggaaccgtacggttagttacgtaacgttacgtacggtaggaacgtacggaccccaggtaaacg

SEQ ID NO: 430984 - DNA, 646 bp, Homo sapiens
  misc_feature: GZ8MTXP02GUQCG.19.71.G05.1.454.CMB.2.raw
  modified_base (458)..(458): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggcacgtgggtcaggcacgtccccagtcgagtaggtctaggagtggcgtaggggaacggactattactttacgatcgtaccacgtacggttaggaaattaaaccgtaaaattacgtacgacctaaacccgtattcgttagttacggagtagttacgactagaactaaagtacaaacggtaanacaacaacgtacgaaactaaccgacgtttaccctaccgtacgactaacggtctacggtacccttcgtacgtacggaacccttccccgggaaagggtaccgtaccgggggttaattaacgttacgtttaacggtacgggttaacggggaaacggtaacccgggtaccccctaaagttaaccggtaaccg

SEQ ID NO: 430985 - DNA, 591 bp, Homo sapiens
  misc_feature: GZ8MTXP02IPMLH.19.71.G05.1.454.CMB.2.raw
  modified_base (242)..(242): a, c, t, g, unknown or other
  modified_base (326)..(326): a, c, t, g, unknown or other
  modified_base (380)..(380): a, c, t, g, unknown or other
  modified_base (456)..(456): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccactaattcttttanactacgttaccaaacaatagaaaactactagcttaggtaccagcagacgaccaggacacgcctcctaggctgctctatttacgnggcatccgtaccgggaagtcccggggtacccctgaccgtattcgaggtcggcgngggcgggtacgtggggacctagtactttccaacgtcctaccactactcagccacgccgtgcgagtcagaagattgngtactagtttatattagactaaatattatttaattaacttagtcgttaggtaccgttcggaacccgtaaagggaaccgtaagggtacggtaattacgaacgtaacggacgtaaacgtgtacggcgttacgacccg

SEQ ID NO: 430986 - DNA, 671 bp, Homo sapiens
  misc_feature: GZ8MTXP02JPTA6.19.71.G05.1.454.CMB.2.raw
  modified_base (203)..(203): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactgggtnaacgccctcgcacgaccctctcgctcacctgtcgcctagtcgtaccggggacaggagtcgctagcgacagtgtgcttggctacgtgggtcaggccacgtccccagtcggagtacggtctagaggtcggcgtagggaacggctaagttactttacagttcgtaccacgtacggtaggtaaactacctaaattgtacgacaacctattcgttagttagagtacgtcgaacttagaaacctaagtaccgtaaacggttacaacgtaaacgtaacgttaacgaaaacggtaaccttaaaccggtttacccctaccgttaacgaccgtaatccgttaacggtacccttgtacgggtacccgtacccgttaccccggggaaaggtaaccccgttacgggggtttaataaccgttaaggttaaccgtagggtaaccggaaacggtacccggacccctttaaggtaaccgtaaccg

SEQ ID NO: 430987 - DNA, 630 bp, Homo sapiens
  misc_feature: GZ8MTXP02JEV4Y.19.71.G05.1.454.CMB.2.raw
  modified_base (225)..(225): a, c, t, g, unknown or other
  modified_base (390)..(390): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctntcgctcacctgtcgccagtccgtccggggacagagtcgctagcgacagtgtgcgttggcacgtgggtcaggccagtccccatcgagaggtctagacgtggcgtaggggaagacattactttcaattcgtaccaaacgtaacggtaggaaaataacgtaaaatttnaggaccaacctatcttaggttagaagtagtcgaccgttagaactaagtacgaaacgtagaacaacgtaactaacgaaacgtaaacctaacgttcccttaccccgagtaccaactaccgggttacgaacccctttgtacggttaccgaacccgtaccccggttaagggaacccgtacgggttaacgttaacttaagtttaccgaggttaacggaaacgacccggacccctaagtaaaccgg

SEQ ID NO: 430988 - DNA, 612 bp, Homo sapiens
  misc_feature: GZ8MTXP02JP9JZ.19.71.G05.1.454.CMB.2.raw
  modified_base (440)..(440): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtcgaacgccctgcacgaccctctcgcctcaccgtgtcgccagtccgtccggggacaggacgtcgcgtagcgacgtagttgtgcgttcggccacggtcggtacgacggcctaccgtcccagtacggtaggtacggttacgtacggaggtcggacggtaaggggaacgtactattacttcgacgtacgtaccaacgtaggtacgtaaataataatatcgaacctactagttcgtaggtnaagttacgacgagtacgaataccgtagtaaacggcaaactacgaacgtaacgaaacgtacgtccgttaccgacaggtacacgtccgtacgtacccgtgacgtccgaacccggtacggacggtacgttacgtagtactcgtacggtaggaccgacgtcccgactaaggtaacc

SEQ ID NO: 430989 - DNA, 559 bp, Homo sapiens
  misc_feature: GZ8MTXP02I2WIL.19.71.G05.1.454.CMB.2.raw
  modified_base (232)..(232): a, c, t, g, unknown or other
  modified_base (242)..(242): a, c, t, g, unknown or other
  modified_base (324)..(324): a, c, t, g, unknown or other
  modified_base (356)..(356): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcaactgacaagtccagccanaattctttanactagttaccaacaatagaaaactcttagcttggtaccagcagacaccaggacagcctacctaggctagctactatttacgnggcatccgtaacccgggatcccccggggtccngaccgtattccgaggttggcaggtcgggtctaggggacagtacttcactctcacatcagcagcctagcgagctagatagtggtgtactagtttaagtattagtaactaataaattatttaatagttaccttaggtcggtacgttcggaccgtaaacggggtaccaagggtgtaataacgtacgagtacgagtggacgtctacg

SEQ ID NO: 430990 - DNA, 620 bp, Homo sapiens
  misc_feature: GZ8MTXP02GURFE.19.71.G05.1.454.CMB.2.raw
  modified_base (413)..(413): a, c, t, g, unknown or other
  modified_base (424)..(424): a, c, t, g, unknown or other
  modified_base (570)..(570): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgacccctctcgctccacctgtcgccacgtccgtccggggacaggacgtcgcgtacggcgacgtagtggttcgcgttgggcctacggttgggtcaagggccacgtccccagtccggagagggtctaggaggtggcgtaggggaagactagttatttcattcgtccgaaacgacggtaggaaataactaaagtttntacgacaactntcgtagttagagtagtcgaacgtagaaacatactaaacgtacgaaactactaacgtacgaaacgaaccctacgtttacctcccgtgaccaggtctaccgtacctcgtcggtacgacccgtaccggaaacggaccggtaacgggttntaacgttaattaacggtggtaacggaaccgccggtaccccgagttaaccg

SEQ ID NO: 430991 - DNA, 557 bp, Homo sapiens
  misc_feature: GZ8MTXP02FS15K.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtcccggggacaggacgtcgctagcgacagtgttgcttaggcacgtgggtcaggccacgtccccagtccgagaggtactaggagtggcgtggggaaagacattatttcattcgtccaaacacggtaggaaatactaaaattatgacacatcgtagttagaagagtcgaactacgaacaaatacaaacgtagaacaacagtacgaaacgtaacctaacgttcctacctgacagctacgacctcgtagtcgaccgtaccgacgacgtacggtagtataagttacgtaggtacggaacgtacggaccccagtaacg

SEQ ID NO: 430992 - DNA, 621 bp, Homo sapiens
  misc_feature: GZ8MTXP02HLQOU.19.71.G05.1.454.CMB.2.raw
  modified_base (241)..(241): a, c, t, g, unknown or other
  modified_base (326)..(326): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccaacaattcttttanacagttaccaaacaatagaaaactactagcttggtaccagcagacgaccaggacacgcctaccgtaggctgcttacattttacgngggactacgtaccgtaaccccggggaagtcccggggtccccctacgacccgtattccgaggtcggcagggcgggtctagggacagtatttcacgtctcactatcgagccagcctgacgagggctagaaagtgttaggacggttacttaaggttttattagttacgtaacctaaataatttattaatttacgtaacgttcggtacggtaccgtttaccgggaaccgtaaacggggtacctaaaaggggttgaacttaagaaccgaaggaaccgtaacgtggtcggtactacggacc

SEQ ID NO: 430993 - DNA, 620 bp, Homo sapiens
  misc_feature: GZ8MTXP02F7QBD.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccgggacagagtcgctagcgacagtgtgcttggcacgtgggtcaggcacgtccccagtcgaggaggtcgtaggagtggcgtaggggaacgactattatttcagtacgtaccacgacgtaggaaattaacaaagttactcgacaacctattctgttagagtacgtacgactacgaaactatacgaacgtaagaaccaacgaacgttaaccgaaacgtaaacccgtagtttacccctcccgttacggactaacgcgttaaccgcccgttcgtacggttaccggaacccgtcccggtaaagggtacccggtaggggttacgtaagtttaaacttccgtagggtaaccggacggtacccggaccccgtaatacggaaccg

SEQ ID NO: 430994 - DNA, 636 bp, Homo sapiens
  misc_feature: GZ8MTXP02GUV5S.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccactccgtccggggacagacgtcgctagcgacagtgttgcgttggcacgtggtcaggcacgtccccagtcgagtacggtctaggagtggcgtaggggaaagactattactttcattcgtaccaaacgacggtaggaaacttaacgtaaaattctacgaccaactattcgtagttagagtacgtcgaactacgaaacaacgtacgaaaacgtagaaactaacgaagttaaccggaaaacgtaacccgtaacgtttccctacccgttacgaccaacggtcctacggtacccttcgtacggttaccggaacccgttacccgggaaaggtaccggtaaccgggttattaaagttaacgttacgttaggaacggaacgtacccggacccctaagtaacccg

SEQ ID NO: 430995 - DNA, 612 bp, Homo sapiens
  misc_feature: GZ8MTXP02JE4L8.19.71.G05.1.454.CMB.2.raw
  modified_base (244)..(244): a, c, t, g, unknown or other
  modified_base (328)..(328): a, c, t, g, unknown or other
  modified_base (581)..(581): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggcggccaccatcaactgcaagtccagccaactaattctttanactacgttaccaaacaatagaaaacctatagcttggtaccagacagaacgaccaggacacgcctcgaggctgctctatttacgngggacctagtacccgtaaccgggaacgtcccggggtaccccctaggacccgtattccgaggttcggaccgtaggggtccgggtcgtaggggaacctagtactttcactctacacctatcagcacgccgtacgacgaggtactaggaaagtagttaggtggtacttagtttattaagttcgtaactaaataaatttattaacgttatacgttgtacggtacgttcggacgaaacgggtaccaagggtacgatanaacgaacgtaacgtacgtgtacggctagacc

SEQ ID NO: 430996 - DNA, 613 bp, Homo sapiens
  misc_feature: GZ8MTXP02GAMJ9.19.71.G05.1.454.CMB.2.raw
  modified_base (324)..(324): a, c, t, g, unknown or other
  modified_base (385)..(385): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagagtcgctagcgacagtgttgcttggcacgtgggtcaggccacgtccccagtccggagacggtctaggngtgggcgtaggggaacgacattatttcagttcgtccaacgtacgtaggaaatactaaattnacgacactatctagtagagtacgtcgaacgtagaacaatacgtaaacgtaacacctaacgtaataccgaaagaaaccctacgttccgtacccttgaccgtagacctacgtacccgttagtacggtacgtacccggtaccggaacggtaccgtaacgggggttactaaacgttaacgttaaccgttagggtacgggaaaacggtacccggacccccgttaagtaaccgg

SEQ ID NO: 430997 - DNA, 638 bp, Homo sapiens
  misc_feature: GZ8MTXP02JR6RB.19.71.G05.1.454.CMB.2.raw
  modified_base (323)..(323): a, c, t, g, unknown or other
  modified_base (383)..(383): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtagaacgccctcgcacgaccctctcgctcacctgtcgccatcgtccggggacagacgtcgctagcgactagtgtgcttggctagtggtcaggcacgtccccagtcgaggtaggtctaggngtggagtacggggaagactatactttcatcgtaccaacgacggtagaaactactaaattnacgacctacctagttctagttagagtactacgacgtagaactaacgtacgtaaaacgagtaaaccaagtaagtaaccgaacggtaaacccttacggtttccctacccgtcgaacacgttcctacggtaaccttcttacgggccgtaacccgttaccggaacgggttacccgtaggggtttaacgtttaacttaacggtttaaacgtacggggttaaacgggtaaccggaaccccgtaaccccgtaagttaacccg

SEQ ID NO: 430998 - DNA, 532 bp, Homo sapiens
  misc_feature: GZ8MTXP02FY9SR.19.71.G05.1.454.CMB.2.raw
  modified_base (432)..(432): a, c, t, g, unknown or other
  modified_base (443)..(443): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcatgtccaggactggtgaagccctgcagacccctctcgctcacctgtgccatcgtccggggacagagtcgctagcgacagtgttgcttggcacgtgggtcaggcacggtccccatcggagaggtctagaggtggccgtaggggaaggacattatttcaatcgtaccaaacgacgtagaaataacaaattatgcaccatctgttgagagtcgactgaacaatacaaacgtagacacatacgaaanaaccagttccnccctgcagctcgacctgtgtcgaccgtaccgacggacctacggggtataagttacgttacgtaggtacggaaacgaccggaccccaaag

SEQ ID NO: 430999 - DNA, 680 bp, Homo sapiens
  misc_feature: GZ8MTXP02G54NF.19.71.G05.1.454.CMB.2.raw
  modified_base (317)..(317): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgggtgaagccctcgcacgaccctctcgctcacctgtcgccatccgtccggggacaggagtcgctaggcgactaggtgttgcttggcacgtgggtcaggcacgtccccagtcgagaggtcaggagtggcgtaggggaagntattatttcattcgtaccaagtacggtaggaaaactacgtaaaattatcgacctaaccgtaattcgtagttagaagtagtaccgactagaaactaaataccaaaacggtagaacacaagttaccggaaacgtaaacccgtacggtttaccctaccccgtagaccgtaacggtcttaccggtaacccttcgttacggtaccgtaacccgtaccccggggaaacgggtaaccgtaaccgggggtttattaaacgttaacgttaaccggtaggggtaaacggaaacgggtacccgtacccccgtaaagtacgaacctacgtaccgtaaccctacgttaccgtctacgtcggtaccgtacttaacgg

SEQ ID NO: 431000 - DNA, 588 bp, Homo sapiens
  misc_feature: GZ8MTXP02G48E7.19.71.G05.1.454.CMB.2.raw
  modified_base (230)..(230): a, c, t, g, unknown or other
  modified_base (239)..(239): a, c, t, g, unknown or other
  modified_base (250)..(250): a, c, t, g, unknown or other
  modified_base (441)..(441): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatcaactgacaagtccagcanaatctttanacagtaccaanaatagaaaactacttagcttggtaccagcagagaccaggacagcctcctaggctagctctatttacgtgggcacgtcgtaaccccggggattccggtcggttcccccagacccgtatttccgaggttcgggcctagggtcgggtccgttaggggacctagtatttccactctaccacactcagcacgtccngcgagcgagagagtagtgtagttagtttattagttagtactaactaattattaattacttacgttacgttacggtacgtacgtacggtaacggtaacgtaacggtagtagtaacgtacgaacgtacgtacgtacgtacgtacgtacg

SEQ ID NO: 431001 - DNA, 636 bp, Homo sapiens
  misc_feature: GZ8MTXP02FS4W7.19.71.G05.1.454.CMB.2.raw
  modified_base (235)..(235): a, c, t, g, unknown or other
  modified_base (246)..(246): a, c, t, g, unknown or other
  modified_base (337)..(337): a, c, t, g, unknown or other
  modified_base (439)..(439): a, c, t, g, unknown or other
  modified_base (447)..(447): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacgaactgacaagtccagcccanaattctttaanactactaccaaactaataacgaaaactacttagtcttacggaaccagacaagacgaaccgaggacacgccctacagctcgctactattcgnggactacgtaccgtaaccggacgtcccgggtacccctacggacctatcgaggtcgcgcgggtcggtcgtacgggaactgtacttcactcctacaccatcgancgtacgcncgacgacgacgtagtaagtagtagtagtagttaagtttattagttacgtaactaaacttaaattaattaattaacgttacgttacggttacggtacggtaccggtaaccggtaaacggtaaacggtaaacggtaacggtaacgtaacgtaacgaacgtaacgtaacgtacggtacggtacgtacgtacg

SEQ ID NO: 431002 - DNA, 647 bp, Homo sapiens
  misc_feature: GZ8MTXP02H1N38.19.71.G05.1.454.CMB.2.raw
  modified_base (183)..(183): a, c, t, g, unknown or other
  modified_base (242)..(242): a, c, t, g, unknown or other
  modified_base (250)..(250): a, c, t, g, unknown or other
  modified_base (290)..(290): a, c, t, g, unknown or other
  modified_base (376)..(376): a, c, t, g, unknown or other
  modified_base (600)..(600): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgggtnaacgccctgcacgacccctctcgcctcacctgtcgccatccgtccggggacagactcgntagcgacngttgtgcgttggcacgtggtcaggcacgtcccagtcgagnggtcgtagaggtggacgtagggaagtactattatttcagtcaaccgtaagtacgtaggtaaactaacgaaatttagacactaccgnttcgtgttagacgtgtacgtaactagaaactactaacgtaaacggtaacaaccaacgtaacgtaacggaaacctaccgtaacgttacccaccgtagactacgtctacgtactacgtcgacgtaccgtaccggtacggaacgttacggttacgtaaagtttacgttaacggttcgggaaaacggtaaccggtacccgaaacccgttaagtaaaccgcgttaaacnccggtaacctaccgttcgtacgttcggtacggttactaacgttacgg

SEQ ID NO: 431003 - DNA, 647 bp, Homo sapiens
  misc_feature: GZ8MTXP02JG0C3.19.71.G05.1.454.CMB.2.raw
  modified_base (390)..(390): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccagtccgtccggggacagacgtcgctagcgacagtgttgcttggcacgtggtcaggcacgtccccatcgagtacggtcaggaggtggacgtaggggaagactattatttcgattcgtaccaaagacggtaggaaactaactaaagtttanacgacacctatcgtagttagagtagtcgaactagaacaacgtacaaacgtaacgaacaactaacgtaacggaaacgtaacccgtagttaccctacccgtagactacggtacctacgtaaccccgttacgttacggttaccgaacccggttacccgggaaacgggtaccgggtaaccggtttagttaaacgttaaacgtttaccggtaacgggttaacgggtaaaccggtaacccggaccccccgtaaagtaacccgg

SEQ ID NO: 431004 - DNA, 701 bp, Homo sapiens
  misc_feature: GZ8MTXP02GOELF.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctcgcacgaccctctcgctcacctgtcgccagtcgtccggggacagacgtcgctagcgacagtgttgcgttggcacgtgggtcaggccacgtccccagtcggagtaggtctaaggaggtgggcgtaggggaaggactaatttatttcaacgttcgttacccgaaacgtaaccggttagggaaaacttaacctaaaaatttacgtacgacctaacctagttcgttaggttagaagtacgtcgtaacgttagaaactaaacgtaacgaaaacgttaacgaaacgtaactaacgttaaccggaaaacgtaaacccgtaacgttttacccaccccgttagaaccgaacgtccgtaacggtacccttaccgtacggttaccgaacccggttacccggaaacgggtaacccgtaacgggggttattaaacgttaacgttacggttacggggttaacgggtaaaaccggtacccggaacccccgtaagttaaaacccgg

SEQ ID NO: 431005 - DNA, 528 bp, Homo sapiens
  misc_feature: GZ8MTXP02ID3NZ.19.71.G05.1.454.CMB.2.raw
  modified_base (311)..(311): a, c, t, g, unknown or other
  modified_base (373)..(373): a, c, t, g, unknown or other
  modified_base (423)..(423): a, c, t, g, unknown or other
  modified_base (437)..(437): a, c, t, g, unknown or other
  modified_base (503)..(503): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaacaatcttttatacagttccaaacaatagaaaacttacttagcttaggtaccagcagagaccaggacagcctctagctgctcatttacngggcagtcctacccgggaatcccggggtcctgacccgtattcgagtggccagccggggtacnggggacagtatttcactctcacatcacgcagcctgcaggcagaagatagnggactagtttattnttagtacaataattattaacttattacttcgtggtacgttcggacagggaaccaggtgaatagtanaagacgtaatggtacgctacgctac

SEQ ID NO: 431006 - DNA, 777 bp, Homo sapiens
  misc_feature: GZ8MTXP02JKY1J.19.71.G05.1.454.CMB.2.raw
  modified_base (233)..(233): a, c, t, g, unknown or other
  modified_base (242)..(242): a, c, t, g, unknown or other
  modified_base (254)..(254): a, c, t, g, unknown or other
  modified_base (328)..(328): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccacgatacactgcaagtccagccanaatctttanacagttccaaanaatagaaaactacttagcttacggaccagcagacgaccaggacagcctccgtaggctacgcttactatttacgngggacctacgtacccgtaaccggggaacgttccccggggtccccccctaggaccccgtattacggacggtcggaccgtaggggccggggttacgtacgggggaaaccctagggttaactttttcccgaaacccgtttcccgttaacccaaaccccctaaattccggaaacggtcccaaccgttcccgtcggtacccgaggggaccttaagggaaacgtggttagggttacggtactttaagggtttttaaccgtttagttacgttaaacccaaaagtttaaacgtttattttaaaccgttaagtttaaaccgttttccgggttacggggtttaacccgggtttaaccgggaaaccggttaaacgggaaacccgttaaagggggttacgtaatttaacggtaacgaacggtaaacgttaaccgtacgggttacggccttaacggaacccc

SEQ ID NO: 431007 - DNA, 654 bp, Homo sapiens
  misc_feature: GZ8MTXP02FPAOV.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctccacctgtcgccatcgtccggggacagagtcgctagcgacagtgtgcttggcacgtgggtcaggcagtccccagtcgagaggtctagagtggcgtagggaacgactatagtttacattcgtaccacgacgtaggtaaataacgtaaatttagtacgacctaacctattcgttagttagagtacgttacgacttacgaactaatacgtaaacgtaagaaccaagtaacgtacgaaacgtaaaccgtaacgtttccctacccgttacggacctaacggtcccgtacggtaacccttcgtacggttaccgaacccgttacccgggaacgggtaacccggtaagggggttaccttaagtttaaaccgttaacgttacggggttaaacggaaaccggttacccgggaaccccctaaggttaaccggaaccg

SEQ ID NO: 431008 - DNA, 574 bp, Homo sapiens
  misc_feature: GZ8MTXP02F0ZA2.19.71.G05.1.454.CMB.2.raw
  modified_base (200)..(200): a, c, t, g, unknown or other
  modified_base (237)..(237): a, c, t, g, unknown or other
  modified_base (245)..(245): a, c, t, g, unknown or other
  modified_base (284)..(284): a, c, t, g, unknown or other
  modified_base (349)..(349): a, c, t, g, unknown or other
  modified_base (429)..(429): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctntcgctcacctgtcgccatcgtccggggacagagtcgntagcgacngtgttgcttggcacgtgggtcaggcagtccccatcgagngtctagagtggctgggaagctatatttcatcgtaccaacgtacgtaggaaacttaacaaaagttntacgactacccgattcgtagttacgaagtacgtcgaactgaacaagtacaacgtagacacatacgaagaacctagttacncccgtagactaggctacgacctctaggtacacccgtccggaggtacgtacggtgtactattacgtggtacggaagtaccggtaccccaagttaacgactaacgtcggaaccctaaccgtcggtcctgtacggttacgtacgttag

SEQ ID NO: 431009 - DNA, 543 bp, Homo sapiens
  misc_feature: GZ8MTXP02I47IY.19.71.G05.1.454.CMB.2.raw
  modified_base (282)..(282): a, c, t, g, unknown or other
  modified_base (341)..(341): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagnggtcagagtggctgggaaggcatatttcatcgtaccaacacgtaggaactacaaattanagcacctatctgttgaagtagtcgactagactaaatcaaacgtagaacaacatacgaacgaacctagttacctaccctgacacgctacgacctctgtcgaccgtccgaggacgtacgggtgtaatattacgtagtaggaaacgacggtaccccagtacgacacgtacgaaccctaccgtcgtctcgtcggtcgactttaagg

SEQ ID NO: 431010 - DNA, 563 bp, Homo sapiens
  misc_feature: GZ8MTXP02I3EHK.19.71.G05.1.454.CMB.2.raw
  modified_base (371)..(371): a, c, t, g, unknown or other
  modified_base (395)..(395): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctgcagaccctctcgctcactgtcgccatcgtccggggacagagtcgctagcgacagtgttgcgttggctacgtgggtcaggctacgtccccagtcgagtgtcgtagagtggcgtagggaacgactagtattcagtcgtaccagacgtagaaatacgaattagngactacatcgttgtagagtacgtnactagaacaacgtacaacgtaacgaacaactaagtaaccgaaaacgtaaccctacgttacccctaccgtagtaccgaacgtcctacgtacccttcgtacgtacgaccgtcccggaaggacgtacgggtatacttagtaacgtgtacggacgaccgacccagtacgaac

SEQ ID NO: 431011 - DNA, 665 bp, Homo sapiens
  misc_feature: GZ8MTXP02H3AUF.19.71.G05.1.454.CMB.2.raw
  modified_base (229)..(229): a, c, t, g, unknown or other
  modified_base (239)..(239): a, c, t, g, unknown or other
  modified_base (249)..(249): a, c, t, g, unknown or other
  modified_base (262)..(262): a, c, t, g, unknown or other
  modified_base (269)..(269): a, c, t, g, unknown or other
  modified_base (310)..(310): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatcgaactgacaagtccagccanaattctttanactatacaanatagaaactatanctagacngacagacgacgagacacgcctcgtagctgctactattacgnggactacgtccgtaccggtacgtcccgggtacctacgaccgtatcgagtcgcgacgggtcggggtcgtaggggactagttactttcacttcctaccaccataccgacgacacgaccgtcgacgacggtacgtaaggaagtagtcggtacggttacgtttagttttaacttacgttaacgtaaacgtaaacgttaaatttaattttaaacgttaacgtttaccggtttacgggttaacgggttaacccgggtttaccgggtaaaccggtaaaacggggtaaccggtaaagggttacgtaacgttaacgtaacgaacggtaacggtaacgtcgggtaacgtcgtacgtaacctaacg

SEQ ID NO: 431012 - DNA, 752 bp, Homo sapiens
  misc_feature: GZ8MTXP02I6NPC.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccatcgtccggggacagacgtcgctagcgacaggtgttgcgttggctacgtgggtcacggccacgtccccagtcggaggaggtctaggagtggacgtaggggaagataagttatttcgagttcgtaccgtaaacgtacggtaggtaaaacttaacgtaaaatttacgtacggaacctaacccgtaaagtttccgttagggtttaggaaacggttacggttaccggaaacctttaggaaaaccttaaacgttacggtaaaaacggttacgaaaacctaacgtaaacgttaaaccggtaaaaccggtaaaaccccttcgtttacccccgtaccccgttagaacccgtacgttaaccgtcccggttaacccttccggtttacggtaaacccggtacccggttaaaccccggaaggggttaacccgtaaccgggggtttactttaaaagttaaccgtttaacggtaaggttaaaccgggggaaacgtaacccccgggtacccctaagggttaaacc

SEQ ID NO: 431013 - DNA, 626 bp, Homo sapiens
  misc_feature: GZ8MTXP02HDLQ7.19.71.G05.1.454.CMB.2.raw
  modified_base (240)..(240): a, c, t, g, unknown or other
  modified_base (338)..(338): a, c, t, g, unknown or other
  modified_base (433)..(433): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaattcttttaanactacgttaccaaactaataacgtaaaacttacttacgtcttacggtaccagacaagacgaacaggacacgcctacgtagctcgctactactttacgnggacacgtccgtaccgggtacgtccgggtacccctacgacctattcgaggtcggacgcgggtcggtgtacgggacagtacttacactctacacanacgagcacgcctcgcgtacggactagaagtgtagtcggtacttagtttattagttacgtaactaaattaatttaatttaattaacttacgttacggttaacggtaccggttaccggtaaaccggaaacgggtaaacgtaagggtacgtaacgtacgtaacgaacgtaacgtacgtcggtacgtacgtacgacg

SEQ ID NO: 431014 - DNA, 636 bp, Homo sapiens
  misc_feature: GZ8MTXP02FM3D4.19.71.G05.1.454.CMB.2.raw
  modified_base (242)..(242): a, c, t, g, unknown or other
  modified_base (255)..(255): a, c, t, g, unknown or other
  modified_base (327)..(327): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatacaactgacaagtccagccacaattctttanacagttaccaaanaatagaaaactacttagcttaggtaccagcagagaccaaggacacgcctacgtaggctagctactatttacngggactagtccgtaacccggggaacttcccgggggtaccccctagacccgtatttccgaggtcggccgagggccggggtactagggggacctagtacttttcccaacttcctcaaccctaatccaagcagccctgaccaggctagaaagtgtgtacggatagttttaattattacgtaataaactaaatttaatttaattaacgttacgttacgttagggtaccgtttcggaccgtaaaacgggaccgtaaaggggttaacgtaagtacgtaacgtaacgaacgtaacgtcggtacgaccgtacgtacg

SEQ ID NO: 431015 - DNA, 747 bp, Homo sapiens
  misc_feature: GZ8MTXP02G6WLT.19.71.G05.1.454.CMB.2.raw
  modified_base (262)..(262): a, c, t, g, unknown or other
  modified_base (334)..(334): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtcctccagacctccctggctgtgtctcgtgggcgaggccgggccaccatcaactgacaagtccagacccactaattcttttatacagttaccaaanaatagaaaactacttagcttaggtaccagacagacgaccaggaccagccctcgtaggctgctactatttacnggcacgtccgtaaccccggggaagtccccggggtcccctacgaccgtattccgaggtcgacgtagggtccggggtacgtacgggggactacggttacttttaccacccttcccgtaccctaaacctactaccgaacgcccgtaacgcccgttaggaccgacggggtacctaagggtaaaagtaggttggtacgggttaacttaggtttttaactttaagtttaacgtaacccttaaaacttaaacttttaaatttaaactttaacgtttaacgtttaccgggtttaaacgggtaccccggtttaacgggaaaccccggtaaaaggggttaacccgtaaaagggggttacgtaacttaaacgtaacccggaaagttaaacccggtacgttacggtaccggtccgttacgacccg

SEQ ID NO: 431016 - DNA, 793 bp, Homo sapiens
  misc_feature: GZ8MTXP02H2PHW.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctccacaaggtgtcctgtcacaagtacagctgcagcagtcaggtccaggactggtgaacgccctcgcacgaccctctccgctcacctgtcgccacgtccgtaccggggacaggacgtcgctaggcgacgagttgtgcgttggctacggtgggtacaggcaccggtaccccagtcgaggtacggtacgtaaggaggtcgggacgtagggggaaacgaactagttactttacgacgttaccgtaccgaaaacggtacggtaaacgggttaaaattaaaaccttaaaagtttacgttaacggaaccctaaaccctaggtttaccgttagggtttaagggaacggtttaaacggttaccccggaaagttaaacggaaaacccttaaagtaacccgtaaaaacggtttaacggaaacctaaacggtttaaaacgtaaacccgggaaaaacgggtaaacccctttaggtttaaccccctaccccggttagaaccgtaacgtccgtttacccgtaaccctttcggtaaccggtacccggttaacccgtaccccggggaaggtaaacccggtacggggtttattaaaccgttaaggttaccggttaagggtaaccgggaaacggtaccccggtaacccttaagtaaacccgg

SEQ ID NO: 431017 - DNA, 637 bp, Homo sapiens
  misc_feature: GZ8MTXP02HQRSU.19.71.G05.1.454.CMB.2.raw
  modified_base (252)..(252): a, c, t, g, unknown or other
  modified_base (349)..(349): a, c, t, g, unknown or other
  modified_base (472)..(472): a, c, t, g, unknown or other
  modified_base (482)..(482): a, c, t, g, unknown or other
  modified_base (507)..(507): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactcctggctgtgtctcgtggggcgaggccgggccaccgatcgaactcgacaagtccagcccaactaattctttttaanacgtagttacccaaacaatagaaaactacttagtcttacggtaaccaggccaggaacgaccaaggacacgccttaccgaggcctgctctatttacgnggacatccgacccgggagtcccggggtcccctacggaacctcttaccgaggtcggcacgggtcgggtcgtaggggactagtactttcacctctaccacctcacgacgcacgcctaggcagggntagaaacgtntcggtaggtattaggtttatacgtntacaaatatttaattacttaatacgttacggttaggtacgtttaccgggacgtaaacgggtaaccgtagggttacggaattaaccgtaacgtaaggaaccgtttaaacggtcggtacgtacgtacgaccg

SEQ ID NO: 431018 - DNA, 602 bp, Homo sapiens
  misc_feature: GZ8MTXP02ILWV4.19.71.G05.1.454.CMB.2.raw
  modified_base (241)..(241): a, c, t, g, unknown or other
  modified_base (253)..(253): a, c, t, g, unknown or other
  modified_base (319)..(319): a, c, t, g, unknown or other
  modified_base (369)..(369): a, c, t, g, unknown or other
  modified_base (415)..(415): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgcaagtccagccacaattcttttanacagttccaaanaatgaaaactacttagcttggtaccagcaagagaccaggacagcctcctaggctgctcatttacgnggcatccgtacccgggaatcccggggtcccctgacccgattcgagtcgcnggtcggtctagggacagtactttcacttcacaccatcagcagcccncgcgacgacgtagagtagtagtgtagttagtttagttagttacgtaactaaactaaattaatttaatttaacgttacgttacgttacggtacggttaccggtaaccggtaaacggtaaacggtaacggtaacggtaacgtaacgtaacgtaacggtaacgtaacgtacggtacggtacgtacgtacg

SEQ ID NO: 431019 - DNA, 645 bp, Homo sapiens
  misc_feature: GZ8MTXP02JOAXF.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccagtcgagtacggtctagagtggcgtaggggaagactattactttacagttcgtacctaaacgtacggtaggaaaacttaactaaaagtttatacgacaaccctaagttcgtgttagagtacgtacgacgtacgaactaaacgtacgaaacgtacgaaacaacgtaacgtaacggaaaacgtaaacccgttacgttaccctacccgtagtaccgtaacgtccgtacgtaacccttcgttacggtaccgtaaccccggttacccggaacgggtaccgtaaccggggttattaacgttaagttacgtacgggtacggaaacggtacccggtaccccgtaagtaaccg

SEQ ID NO: 431020 - DNA, 710 bp, Homo sapiens
  misc_feature: GZ8MTXP02GMC3Q.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgactagcgacagtgtgcttggcacgtggggtcaggcacgtccccatccggagaggtctaggagtggcgtagggaacgactagttatttcaatcgtaccaacgtacgtaggtaaaatacctaaaatttactacgaccaaacccgtaattcccgttagggttagaaaggtacgttaccgaaccgtttaagaaacctaaattaaacccgaaacgggttaaacgaaacccgtaaaccaaaagttaaccggaaaaaccggttaaaacccttaacggtttaccccctttcccgtaggtaccctaaaggcctacggtaaacccgttccttacggtttacgacccgttacccggaaaccgggtaaccggtaccgggttaacggttaagtttaaaccgtttaacggttacggttaacgggtaaaacgggtaaccgggtaacccctaaccggtaacgtaaaccg

SEQ ID NO: 431021 - DNA, 665 bp, Homo sapiens
  misc_feature: GZ8MTXP02G3VQN.19.71.G05.1.454.CMB.2.raw
  modified_base (227)..(227): a, c, t, g, unknown or other
  modified_base (237)..(237): a, c, t, g, unknown or other
  modified_base (246)..(246): a, c, t, g, unknown or other
  modified_base (250)..(250): a, c, t, g, unknown or other
  modified_base (256)..(256): a, c, t, g, unknown or other
  modified_base (259)..(259): a, c, t, g, unknown or other
  modified_base (301)..(301): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccanaatctttaanacatacaanatanaaactntanctgacagcagacgacagacagcctctagctgctatattacgnggactatccgtaaccgggtacgtcccggggtacctacgaccgtattcgaggtcggacgaggtccggggtcgtagggaccagtactttacacctctaccacctactacgacgacgacgtaccgtacgacgacggtactacgaacgtagtagggtacgtacgttaagtttaagttaacgttacgtaaacgtaaaactaagtttaaatttaaacgtttaaacgtttaccgtttacggttaacggttaaccggttaaccgggtaaaccggtaaaacggggtaaaccggtaaacgggttaacggtaacgttaacgtaaccggtaaggtaaacggtaacgttacgggtacggtacgtacggacctaaccg

SEQ ID NO: 431022 - DNA, 574 bp, Homo sapiens
  misc_feature: GZ8MTXP02FMHBO.19.71.G05.1.454.CMB.2.raw
  modified_base (232)..(232): a, c, t, g, unknown or other
  modified_base (242)..(242): a, c, t, g, unknown or other
  modified_base (298)..(298): a, c, t, g, unknown or other
  modified_base (321)..(321): a, c, t, g, unknown or other
  modified_base (410)..(410): a, c, t, g, unknown or other
  modified_base (424)..(424): a, c, t, g, unknown or other
tcagtactctcgtgcacgaccggtgctcgatttagtgtcgtcgcaagagagaggggggggtacaacaggcaggcagtggcagcaagatggtgttgcagacccaggtcttcatttctctgttgctctggatctctggtgcccaggggacatcgtgatgacccagtctccagacctccctggctgtgtctcgtgggcgaggccgggccaccatcaactgacaagtccagccaanaattctttanactagttaccaaacaatagaaaactctagcttggaccagacagagaccagacggancctcgaggctgctctatttacgnggcagtccgaacccggggaattcccggggcccctaggacccgtattccgaggtcgcaggtcgggtctagggactaggtactttcactcncaccatcagctacncctgaccgtgatagaaagtgtaggtgtaacttagtttaagttatacgtaaactaaattatttaatattacgttacgtcggtacgttacggtacgtaaacgaacgggtacgtaggtacgattacgaagaacgtacagtcgactcgacaacc

SEQ ID NO: 431023 - DNA, 708 bp, Homo sapiens
  misc_feature: GZ8MTXP02HGJZU.19.71.G05.1.454.CMB.2.raw
  modified_base (211)..(211): a, c, t, g, unknown or other
  modified_base (513)..(513): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgaggcgggccacncacacacgcacgtacacgacacaatactttacttacacgtacctaacaaatagaaaactaaacttacgtacttacggttaccgaacgacgacgaacgaaccgacggaagaccgaccgtccctacggtacgtacgtccgtactactttaaccgttggggacgacttaccgtaccccggggtaaacggtccggggttccccccccgggtaccgtaccgggtaacttcgtacgtacgggccgaggggtccgggcggttcgggacgtagtactttcctacctctactacccaacgtcaggtaaccncgaccgtcggacgacgacgtagtaaggtacgttggtacggttattaacgttttagtttaacgttacgtacttaaactaatttaaatttatttaacgtttacgttcggttacggtacggtttacggaaccggaaaggtaaccggaagtacggtagtaacgtaacgaacgtaacggtcgtacgtcgtacgtacgtac

SEQ ID NO: 431024 - DNA, 551 bp, Homo sapiens
  misc_feature: GZ8MTXP02FU16O.19.71.G05.1.454.CMB.2.raw
  modified_base (371)..(371): a, c, t, g, unknown or other
tcagtactctcgtgcacgaccggtgctcgatttagtgtcgtcgcaagagagaggggggaggtacaacaggcaggcagggggcagcaagatggtgttgcagacccaggtcttcatttctctgttgctctggatctctggtgcccacggggacatcgtgatgacccagtctccagactccctggctgtgtctctgggcgagccgggccaccgatacgaactgacaagtccagccacaatctttatacagttaccaacaatagaaaactacttagcttggtaccagcagagaccaggacagcctcctaggctgctcatttactgggcatccgtacccggggaatcccggggtccccctgaccgattcagtggcnggcgggtctggggactagtatttcactctcacccatcagcagcctagccaggctgaaagatggtggactaggtttaattattgtacaaactaattattaattaattacttacggtcggtacgttacgaccgaaacgggacccaaggtggactatcgaagacgtacgtgtcggtctcgacc

SEQ ID NO: 431025 - DNA, 666 bp, Homo sapiens
  misc_feature: GZ8MTXP02IAHRJ.19.71.G05.1.454.CMB.2.raw
  modified_base (225)..(225): a, c, t, g, unknown or other
  modified_base (383)..(383): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctntcgctcacctgtcgcccatccgtccggggacagagtcgctagcgactagtgttgcttcggcacgtgggtcacggcacgtccccatcgagagtctagagtggcgtgggaaagactattatttcattcgtaccaacgtacgtaggaaactacgaaaattntacgactaccattcgtagttagagtacgtacgaactggaaacctaaactaccgaaaacggttaacgaaacctaacgtaacgttaaaccggaaaaacggtaaccccttaaacggtttcccttacccccgttaggaacccgtacggtaccttaccgggtaaccctttcggttacggtacggtaaccccgttacccgggaacgggtaccggtaaccgggggtttacttaagttaacgtttaccggtaggttaaacggaacggacccggtaccccctaagtaaaccg

SEQ ID NO: 431026 - DNA, 555 bp, Homo sapiens
  misc_feature: GZ8MTXP02IAH8U.19.71.G05.1.454.CMB.2.raw
  modified_base (227)..(227): a, c, t, g, unknown or other
  modified_base (320)..(320): a, c, t, g, unknown or other
  modified_base (336)..(336): a, c, t, g, unknown or other
  modified_base (349)..(349): a, c, t, g, unknown or other
  modified_base (399)..(399): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggganagagtcgctagcgacagtgtgcttggcacgtggtcaggcagtccccatcgagagtctagagtggctgggaagacagtatttcatgtaccaaancgtgaactacaaattngcacatctgttanacgatacgactgaacaatacaaagtagaacacatacgaaagaacagtacncctgacagctacgacctctagtacgaccgtaccgacggactacggggtataataacgttaccgtacggttaggaaacggacggacccccaagttacgacgtaactacggaaccctaaccggttcctaccgtaccgtgggtaccgtatttaaaccgg

SEQ ID NO: 431027 - DNA, 709 bp, Homo sapiens
  misc_feature: GZ8MTXP02IAE8Q.19.71.G05.1.454.CMB.2.raw
  modified_base (247)..(247): a, c, t, g, unknown or other
  modified_base (336)..(336): a, c, t, g, unknown or other
  modified_base (368)..(368): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccacgatacaacgtgacaagtccagccaacaattcttttaanactacgttaccaaactaatacgtaaaacttctagtcttaggaaccagacaagacgaccgaggacagccctcgtaggctgctcattacgnggctatccgaaccggggtactcccggggtccncgaccgtattccgaggtcggcgtagggccggggttacgacggggaacctaggttaactttccgaaccctttccaccctaacccaatccgaacgccacgtacccgtgaccgaaggtcctaggaaagtacgttggtagggtactttaaaggttttattagtacgttaaacctaaaacttaattaacttttaagtaaactttccggttaacgggtaacgggttaccgtttaacccggggaaccggaaaacgggttaaaccggtaaagggtacgtaaacttaacgtaccggaaaacggtacccggtaaaacgttgggttaaccggcctacggttaaccctaaccg

SEQ ID NO: 431028 - DNA, 583 bp, Homo sapiens
  misc_feature: GZ8MTXP02FSEZP.19.71.G05.1.454.CMB.2.raw
  modified_base (255)..(255): a, c, t, g, unknown or other
  modified_base (321)..(321): a, c, t, g, unknown or other
  modified_base (354)..(354): a, c, t, g, unknown or other
  modified_base (373)..(373): a, c, t, g, unknown or other
  modified_base (422)..(422): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccgggganagacgtcgcgtagcgacaggtgttgcttggcacgtgggtcaggcacgtccccatcgagaggtcagngtggcgtggggaagacatagtttcatgtccaanacgtagaataacaatttancgacaccattctgttagagacgtcgaactagaacaactacaaacggtanaacaacaatacgaaaacgaacctacgttcctacccgtagacagtaccgtacgtaccccgttcgtacgttaccgacccgtacccggaggaacggtaccgggttagttaacgttaacgtttacgtaggttacggaaacggtaccggacccccgtaaagtaacg

SEQ ID NO: 431029 - DNA, 543 bp, Homo sapiens
  misc_feature: GZ8MTXP02I0BZK.19.71.G05.1.454.CMB.2.raw
  modified_base (242)..(242): a, c, t, g, unknown or other
  modified_base (306)..(306): a, c, t, g, unknown or other
  modified_base (397)..(397): a, c, t, g, unknown or other
  modified_base (413)..(413): a, c, t, g, unknown or other
  modified_base (450)..(450): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctgtgggcgaggcgggccaccatcaactgacaagtccagccaacaattcttttanactagttccaacaatagaaaactacttaagcttgtaccagcagagaccagacagcctctagctnggggtcattactggcatctacccggacgtccccggggtccctgaccgacttcagtggcgagcgggtcgtgggacaggtacttcgaccttcncctaccactcagcacnctgcagctagaagagtgtgactaggttattattgtanaactaattattattatattcgtagtacgttacggtaccgaaggaccgagggtagtagtaagttaccgaggtaccgaagtaggtcgtacgtcgg

SEQ ID NO: 431030 - DNA, 583 bp, Homo sapiens
  misc_feature: GZ8MTXP02IZ9S8.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgactagtgtgcttggcacgtggtcaggcacgtccccatcgagaggtctagacgtggctaggggaaacgactagttactttcaattcgtaccaaacgtacggtaggaaacttaactaaaattagtagaccaacctaatctaggttgaagacgttcgaactgaaaccaaatacaaacgttagaacaaccgtatacgaaagtaaaccctagttcctaccctgacagtctacgaacccttcgtgtacgtaccgtacccggaaggtacgacgggttatattaacgttacgtaggtaacggaacggtaccgaccctaaggtaacg

SEQ ID NO: 431031 - DNA, 604 bp, Homo sapiens
  misc_feature: GZ8MTXP02G3656.19.71.G05.1.454.CMB.2.raw
  modified_base (228)..(228): a, c, t, g, unknown or other
  modified_base (237)..(237): a, c, t, g, unknown or other
  modified_base (247)..(247): a, c, t, g, unknown or other
  modified_base (251)..(251): a, c, t, g, unknown or other
  modified_base (257)..(257): a, c, t, g, unknown or other
  modified_base (267)..(267): a, c, t, g, unknown or other
  modified_base (307)..(307): a, c, t, g, unknown or other
  modified_base (413)..(413): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacatcaactgcaagtccagccanaatctttanacataccaanatanaaactntagctgacancagacgacgagacacgcctcgagctgctactagtttacgnggactacgtccggtaacccggacgtcccgggtaccccctagaccgtatcgaggtacgcgcgggtccgggtacgtacgggactagtactttccacctctaccactancgacgccacgccaggacgagcgtagaaagtgtggtacgtattagtttatagtacgtaactaaattaatttagtttaacttacgtacgttcggtacggtaccggttacgaaaccggtaaacgggtaaccgtaacggtacgtaactaacgtaacgaaacggtaaccgaacgttcggtacggtacctacgaccg

SEQ ID NO: 431032 - DNA, 627 bp, Homo sapiens
  misc_feature: GZ8MTXP02I75UO.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcgaggtccaggtactggtcgaacgccctcgcacgaccctctcgctccaccgtgtcgcctagtccggtccggggacaggacgtcgctagcgactgtgtgcttggcagtggtcagcacgtcccagtcgagcgtcagaggtggcgtaggggaacgacgtaatttacgtttcgaacgttcgtacccgaaagtaccggtaagaaacttaacgtaaatttagtacgaccaaccgtaattcgtagttacggagtacgtcctaatagaacaagtcgtaaaacgtagaacccaagtaacgaacgaaaacgtaaccctgtttccccaccgtgactacgtaccgtacgtaccttcgtcgaaccgtacccgtacggaacgtacggtacggttagttaaacttaacgttacggtaacggtacggaacccgtacccggtaaccctaagtaacg

SEQ ID NO: 431033 - DNA, 636 bp, Homo sapiens
  misc_feature: GZ8MTXP02ITIFV.19.71.G05.1.454.CMB.2.raw
  modified_base (316)..(316): a, c, t, g, unknown or other
  modified_base (389)..(389): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaagccctcgcacgaccctctcgctcacctgtcgccatcgtccggggacagagtcgctagcgacagtgttgcttggcacgtgggtcaggcacgtccccatcgagaggtctagngtggcgtaggggaacggacagttatttcgattcgttacccacgtacgttacggaaattaaacctaaatttagngtaccaaccctatcttgttaggagtagtacgtactacggaactaaactacgaaacgttaagaaactaacgaacttaacgaaacgtaaaccgtaacggtttaccctacccgttacgaccgtaaacggtcgtacgtaacccgtcgttacgtacggtaccgttacccggaacggtacgtaccggggttagtacgttaacgttaaccgtggtacgggtaacggaccggtacccccgaagttaacggaaccg

SEQ ID NO: 431034 - DNA, 828 bp, Homo sapiens
  misc_feature: GZ8MTXP02FT34E.19.71.G05.1.454.CMB.2.raw
  modified_base (242)..(242): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgaggccgggccaccagtccaactgacaagtccagccactaatcctttanacagttaccaaacaatgaaaactcttagcttggacagcagagaccagacagcctcctagctgctacatttacgcggctaacgtcccgtaacccggggaaacgttccccgggggtaccccccttacgggaaaccccgtaggtttcccggggagggacccgtaacggggtccggggggtttcctagggggggaaaccctaaggtttaaccgtttttccgaaaccggtttccccttacccgaaacccgttaaacgtacccgaaagggtcccctaaaccggtccccgttcggacccggtaaagggggtacccgttaacgggaaaaggttaacgtttaggggttgggtaacccttttaaagggttttttaaacttttaaaggtttcggttaaaaccctaaaagtaaaactttttaaactttttaaacgtttaatttaaaccccggttttcggttaaggggttaacccggttttacccggggaaaccgaaaacgggggtaaccgtaaaacggggttcgtaaaacggtttacgtaaacggtaaacggtaaacggtaaacgttcgggtaccggtacgtaccggtaacctaaacg

SEQ ID NO: 431035 - DNA, 593 bp, Homo sapiens
  misc_feature: GZ8MTXP02JFINX.19.71.G05.1.454.CMB.2.raw
  modified_base (235)..(235): a, c, t, g, unknown or other
  modified_base (243)..(243): a, c, t, g, unknown or other
  modified_base (251)..(251): a, c, t, g, unknown or other
  modified_base (253)..(253): a, c, t, g, unknown or other
  modified_base (255)..(255): a, c, t, g, unknown or other
  modified_base (260)..(260): a, c, t, g, unknown or other
  modified_base (263)..(263): a, c, t, g, unknown or other
  modified_base (312)..(312): a, c, t, g, unknown or other
  modified_base (428)..(428): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccgatacgaactgacaagtccagccanatctttanacatacanananaactntanctagacagcagacgacagacacgcctacgagctgactactagtttacgnggactacgtaccggtacccgggacgttcccgggtacccctacggaccgtattcgaggtcggacgcggggtccgggtcgagggactagtactttcactctacaccagacacgcgacnccgagacgagactagaaagtgtaggtagtattagtttattagttacgtaactaaattaattatttaattacgttacgttacggtacggtaccgttacggaaccggaaaggtaacggtaaggtacgtaatagaacgaacgtaacgtacgtgtacgacgtacgaccg

SEQ ID NO: 431036 - DNA, 563 bp, Homo sapiens
  misc_feature: GZ8MTXP02G6B3P.19.71.G05.1.454.CMB.2.raw
  modified_base (243)..(243): a, c, t, g, unknown or other
  modified_base (315)..(315): a, c, t, g, unknown or other
  modified_base (323)..(323): a, c, t, g, unknown or other
  modified_base (359)..(359): a, c, t, g, unknown or other
  modified_base (367)..(367): a, c, t, g, unknown or other
  modified_base (374)..(374): a, c, t, g, unknown or other
  modified_base (390)..(390): a, c, t, g, unknown or other
  modified_base (402)..(402): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccatcaactgacaagtccagccactaatcttttanacacgttaccaaactaatagaaaactcttagcttaggaccagcagacgaccaggacacgcctcaggctgctntatttcgnggcacgtccgtaccgggatcccgggccctgaccgtntcagtgcnggcggtngggactagtacttccnctcgtcacctancgagctagccctgcgacggtctagaaagtgtgtggactagtttattactgtaacaattattaattagttactacgtttcggtacgtacgttacggacctaaagggggaacctagggtacgtaattagaaccgagtaacgtaactggtcggacttcggaacc

SEQ ID NO: 431037 - DNA, 631 bp, Homo sapiens
  misc_feature: GZ8MTXP02JQU91.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctaggagtggcgtaggggaaggactagttatttcatcgtaccaaacgacggtaggaactactaaattatcgacaccattctagttggagtagtaccgtacgtacgactaaataccgaaacggtacgaacaacagtacgaaacgaacccgtacgttcctaccctgactacggccttacgaccttcgtacggtacgtacccgtaccggacgggtaccgtacggggttacttaacgttacgtttacggtaggttacgggaaacggaacccggtaccccctaagtaaccgactaccgttaccgaaccctacccgttaccgtcctccgttaggtcgtacgtttaaacgg

SEQ ID NO: 431038 - DNA, 713 bp, Homo sapiens
  misc_feature: GZ8MTXP02HP4FW.19.71.G05.1.454.CMB.2.raw
  modified_base (243)..(243): a, c, t, g, unknown or other
  modified_base (257)..(257): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtcctccagacctccctggctgtgtctcgtgggcgagccgaccaccatcaactgcaagtccagccactaattctttanactagttaccaaanaatagaaaactcttagcttaggaccagcaagacgaccgaaggacacgccctcgaggcctgctctaatttacgtggactacgtaccgtaccccgggagtccccggggtccccctaggacccgtattcgaggtcggcgtacggggtcgggttctaggggacctaggtactttaccaccttcctacccaaccctataccgagacccgtacgtccccgtgacccgagggtaccttaaggaaacggtgttgggtacggttaaccgtttaaggttttaactttaagtttacggtaaaccttaaacttaaattttaacgtttaatttaacgtttaaccgtttacgggttacgggttaaccggtttccggggaaacccgaaaacgggggttaacccgtaaaggggtcgttaaagtaccgtaaccggaaaggtaaccgttaacgtggtacggtacctacgacccg

SEQ ID NO: 431039 - DNA, 665 bp, Homo sapiens
  misc_feature: GZ8MTXP02FSGVK.19.71.G05.1.454.CMB.2.raw
  modified_base (231)..(231): a, c, t, g, unknown or other
  modified_base (242)..(242): a, c, t, g, unknown or other
  modified_base (327)..(327): a, c, t, g, unknown or other
  modified_base (398)..(398): a, c, t, g, unknown or other
  modified_base (458)..(458): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctcagactccctggctgtgtctcgtgggcgagccgggcaccgatacaactgacaagtccagccanaattcttttanactagttaccaaacaatagaaaactacttagcttggaccagacagaagaccgaggaccagcctccgaggctgctactatttacgngggacctacgtaccgtaccggggtaacttccccgggggtccccctaggaccccgtagttcgagtcggaccnggggcgggtcgtaggggacctagttactttcaactcctacactactcgacgcacgcccgngacgagtacaagtaggtagtcggtacgttagtttaagttttaacttacgtaacgttaattaaacttaatttaatttaacttacgtttaacggttacggttaacgggtaaccggttacggaaccgggtaaacgggtaacgtaaagggttacgtaacgttaacgtaacgtaaacggtaacgttacggttaggtacggtaccgtacgacc

SEQ ID NO: 431040 - DNA, 699 bp, Homo sapiens
  misc_feature: GZ8MTXP02FUOJ2.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctccacctgtcgccctagtccgtaccggggacaggacgtcgctaggcgacgtagtgttgcgttggctacgtgggtcaggcacgtccccagtcggagtaggtcgtaggaggtggacgtaggggaacggtactagttatttacgatacgtacccaacgtaccggtaggtaaaacttaactaaatttacgtacggacctaaccgtaatttcgttagttacggaaggttacgtacgaaccgttagaaacctaaacgtaccgaaacggttaagaaccaactaacgtaaccgaaaacgtaaacccgttacgtttcccctacccgtagacccgtacgtccgtacgtacccgttcttacggtaccgtaacccggtacccggaaacggtaccggttaccggggttaattacgtttaaacgttaaccggtaggggtaaccggaaaccggtaccccggtaaccccgtaagttaccggtaaaccg

SEQ ID NO: 431041 - DNA, 674 bp, Homo sapiens
  misc_feature: GZ8MTXP02GQI3F.19.71.G05.1.454.CMB.2.raw
  modified_base (319)..(319): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccggggacagagtcgctagcgacagtgtgcttggcacgtggtcaggccacgtccccagtcgagacggtctaaggngtggcgtaggggaagactattactttcattcgtaccaaacgaacggtaggaaaactaacgtaaaatttacgtacgacctaaccgtaacgttacgttacggttaggaagtacggtaccgtaacgttacgaaacgaaacttaacgaaaccggttaacgaaactaacctaaagtaccggaaaacggtaaaccctaacggtttacccttacccgttacggactaacgtccgtacgtaacccgttcgtacggtaccgtacccgttacccggaacgggaaccgtaaccggggttagttaacgtaacgtttaacgttaacggtacgggtaaaccggaaccggtacccccgtaagtaaaccgg

SEQ ID NO: 431042 - DNA, 585 bp, Homo sapiens
  misc_feature: GZ8MTXP02I94ZN.19.71.G05.1.454.CMB.2.raw
  modified_base (239)..(239): a, c, t, g, unknown or other
  modified_base (318)..(318): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccaactaattctttanacagttccaaacaatagaaaactactagcttaggtaccagcagagaccaggacagcctactaggctagctctatttacncgggctaatccgtaacccggggaagtccccggggtccctacgaccgtattcaggtcggcaggtcggggtctggggacagtactttcgactctacaccatcagcagcctgctaggctagaagtactggtacggcttaagtttatttagttagtaccaaataatttaattattaattacgttcgtaggtaccggttacggacgtaaacgggacgtaaaggtacggtaatacgtacaaggtacgtaacgttggacgtctacgactaaccg

SEQ ID NO: 431043 - DNA, 705 bp, Homo sapiens
  misc_feature: GZ8MTXP02HLTPM.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgcctcacctgtcgcctagtccgtccggggacacggacgtccgcgtagcgacagttgttgcgtttggcacgtgggtcaggcacgtccccgagtcggagtacggtctaggtaggtcgggacgtacggggaaacggactagttaatttcagttcgtacccaaacgtacggtagaaaacttaactaaagttatacggaccaaccgtagttacgtaggttagaagtacgtaccgaactacgaaactaaacgtaccaaacggtacaaacgtaacctaacgtaaccggaaacgtaaacccgttacgtttacccgtaccccgttagaccgaacggtccttaacggtaacccctttcggtacggttacccggtaaaccgttaccccggggaaagggtaaccgttacgggggttaacttaaacgtttaacggtttaccgtaagggttaacgggaaaaccggtacccggaacccccgtaagttaacccgg

SEQ ID NO: 431044 - DNA, 645 bp, Homo sapiens
  misc_feature: GZ8MTXP02G4VF8.19.71.G05.1.454.CMB.2.raw
  modified_base (244)..(244): a, c, t, g, unknown or other
  modified_base (383)..(383): a, c, t, g, unknown or other
  modified_base (423)..(423): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatacgaactgacaagtccagccacaattctttanacagttaccaaacaatagaaaactacttagcttaggaccagcagagaccaggacagcctcctaggctgctcatttacgtggactacgtccgtaacccgggagtcccggggtcccctggacccgtattccgaggtcggcncgggcgggtctggggacagtactttcactctacaccctancgagcacgcctacgacgacgacgtagtaagtagtacggtacggtacgttaagtttaagtttaagtttacgttaactaaacttaaatttaatttaatttaacgtttacgtttacggttacggttacggttaccggtaaccggtaaacgggtaacggtaacgggtaacggtaacgttaacgtaacgtaacgtaacggtaacgtacggtacggtacgtacgtacg

SEQ ID NO: 431045 - DNA, 620 bp, Homo sapiens
  misc_feature: GZ8MTXP02FQFXP.19.71.G05.1.454.CMB.2.raw
  modified_base (378)..(378): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatcgtccggggacagagtcgctagcgacagtgtgcttggcacgtgggtcaggcacgtccccatcgagaggtctagagtggcgtggggaagacattactttcattcgtaccaaacgacgtaggaaatactaaaatttanagaccaactattcgtagttgaagtacgtcgactagaactaaatacgtaaacgtagaacactagtaaccgaaagaaacctacggttacctaccgtacgacgacgtactacgacctttacgtacggtacgtaacccgttacccgggaaacgggtaccgtaaccggggttacgtttaaacgttaagtttaaccggttagggttaacgggaaaccggacccgggtaaccccctagttaaaacccgg

SEQ ID NO: 431046 - DNA, 628 bp, Homo sapiens
  misc_feature: GZ8MTXP02FTP2V.19.71.G05.1.454.CMB.2.raw
  modified_base (246)..(246): a, c, t, g, unknown or other
  modified_base (304)..(304): a, c, t, g, unknown or other
  modified_base (330)..(330): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacgaactgacaagtccagccaactaattctttanactacgttaccaaactaatagaaaactacttagcttaggaccagcagagaccaggacngcctcgtaggctgctactatttacgnggactacgttcccgaacccggggtacgtcccggggtaccccctacgtaccgatttcgaggtggacctgggccgggtctagggaacctgtactttccacttcctacaccatcgagcacgcctgactagacaggtaaagtgtggtacggtattaagttttaacttagttacgtaacaaaattatttaattagttacttaacgttcggtacggtaccgttaccgggaacgtaaaacgggtaccgtaaaggtacggtataacgtaacgaaacgtaccgtaacgtggttaggacttcggaacc

SEQ ID NO: 431047 - DNA, 732 bp, Homo sapiens
  misc_feature: GZ8MTXP02IYRHO.19.71.G05.1.454.CMB.2.raw
  modified_base (240)..(240): a, c, t, g, unknown or other
  modified_base (302)..(302): a, c, t, g, unknown or other
  modified_base (340)..(340): a, c, t, g, unknown or other
  modified_base (531)..(531): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgacaagtccagccaactaattctttanactacgttaccaaacaatacgtaaaacttcttagcttaggaccagacaagacgaccaggacncgtccctacgtaggcctgaccttactaagttttaccgngggcctaagttccccggtaaaccccggggtaacgtcccccgggggtacccctaggaaccccgtattccgaaggttcggacctagggtccgggggttctacgggggaaacctaggttacctttccaaccttcctacctaaccctataccgagaccctaacgccgttaggaccgtaggtacctaaggaaacgngttagggtaccggtaacgtttaaggttttaattacggttacgtaaacctaaattaaatttaattttaaacttacgtttacgttcgggttaacgggttaccggttaccgggaaccggtaaacggggaaccgttaaagggtacggtaaattacgtaacgaacggtaaacgtaaccggttcggtagaccgttacaacccgtaac

SEQ ID NO: 431048 - DNA, 623 bp, Homo sapiens
  misc_feature: GZ8MTXP02H7ZXK.19.71.G05.1.454.CMB.2.raw
  modified_base (151)..(151): a, c, t, g, unknown or other
  modified_base (219)..(219): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctggcctcccanaaggtgtcctgtcacaagtacagctgcagcagtcaggtccaggactggtgaacgccctgcagaccctntcgctcacctgtgccagtccgtccggggacagcgtcgctagcgacagtgttgcttggctacgtgggtcaggccacgtccccagtcggagtcggtcaggacgtggacgtaggggaacgactattacttcatacgtaccatacggtagaaacttaacgaaattactacgacaaccgtatctagttagagacgtacgtacgagaaactaagtacaaacgtacgaactaaccgtaagttaacgaaaccgtaaacctacggttaccctaccgttacggacacggtacctacggtaacccttccgttacggtaaccgtaccgttacccgggaaggtaaccggtacgggttaacggttacttaagttaacgttaacggacggtaaacgaccggaccctaaagtaccgaacg

SEQ ID NO: 431049 - DNA, 597 bp, Homo sapiens
  misc_feature: GZ8MTXP02FVO7E.19.71.G05.1.454.CMB.2.raw
  modified_base (240)..(240): a, c, t, g, unknown or other
  modified_base (322)..(322): a, c, t, g, unknown or other
  modified_base (385)..(385): a, c, t, g, unknown or other
  modified_base (579)..(579): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccataattctttanacagttaccaaacaatagaaaactacttagcttaggtaccagacagagaccagacacgcctcgaggctagctactatttacngggcctagtccgtaacccgggtacgtcccggggtccccctagacccgtatccgaggtcgacgnggcgggtcgtaggggactagtactttacacttctacaccatcagcacgcctgcgtagcagaatgtgtggcttagtttatagttacactaaactatttaattattacttacgttcggttacggtaacggtttcggtaaccgaagggtaaaccgtaagggttacggtaattacgtaaccgaaggtaaccgtaacgnggttacggactcgaaccg

SEQ ID NO: 431050 - DNA, 725 bp, Homo sapiens
  misc_feature: GZ8MTXP02GIKP3.19.71.G05.1.454.CMB.2.raw
  modified_base (254)..(254): a, c, t, g, unknown or other
  modified_base (326)..(326): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggganagacgtcgctacgcgacgagtgttgcgttggcacgtgggtcaggcacgtccccagtcggagtaggtctaggnggtggcgtaggggaacgtactagttactttcaagttcgtacccaaacgtacggtaaggtaaaacttaaacctaaaagtttactaccggaaacctacccgttaaagtttccgttaggtttaacggaaacggttaacggttaccgtaaaccgttaggaaaacctaaaacgttaacccgtaaaaaccgggttacaaaccgtaaacgtaaacgttaaacccggaaaaccggttaaaccccgtacggttttccctaaccccgttgacccgtaaacgtcccgtacgttaccccgttacggtacgtacccggtacccggtacccgggaaacgggtaccggtaccggggttattacgttaacgtacggttaggaacgggtaacggacccggacccctaaggtaaccg

SEQ ID NO: 431051 - DNA, 678 bp, Homo sapiens
  misc_feature: GZ8MTXP02IWN87.19.71.G05.1.454.CMB.2.raw
  modified_base (247)..(247): a, c, t, g, unknown or other
  modified_base (259)..(259): a, c, t, g, unknown or other
  modified_base (333)..(333): a, c, t, g, unknown or other
  modified_base (445)..(445): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtcctccagacctccctggctgtgtctcgtgggcgaggccggccaccatcaactgacaagtccagaccactaattctttanacagttaccaanaatagtaaaactctagcttaggaccagacagacgaccgaggacacgtcctacgacggctcgctactatttacgnggacctacgttcccgtaccccggggaagtccccggggtaccccctgaacccgtgttaccgaggtacggcgagggtccgggtcgtgggactagtactttcgactctacacctntacgacgcacgcctaggcgacggtactagaaagagttcggtacggttacttaagtttatttacgtagttaacctaaacgtttaaattaaatttacgtttaacgttacgttacggggtacgggttaccggtttaccgggaaaccggtaaacggggtaaccgttaagggtaaggttaacttaacgtaacgaaacggtaacggtaaaccgttgggtaccggttactacgtaacccg

SEQ ID NO: 431052 - DNA, 566 bp, Homo sapiens
  misc_feature: GZ8MTXP02IM72X.19.71.G05.1.454.CMB.2.raw
  modified_base (236)..(236): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (265)..(265): a, c, t, g, unknown or other
  modified_base (270)..(270): a, c, t, g, unknown or other
  modified_base (279)..(279): a, c, t, g, unknown or other
  modified_base (302)..(302): a, c, t, g, unknown or other
  modified_base (361)..(361): a, c, t, g, unknown or other
  modified_base (395)..(395): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacatcaactgcaagtcagccacaatcttttaanacatacaanatanaaactntanctgacancaganacagacacncctctagctgctactatttacgnggactacgtaccgtaaccggacgtcccggggtcccctacgaccgtattcgagtcggcgngggtcgggtacgtagggactagtactttcactcncacatcagcacgcctgacaggctagaaagtgtaggtagtacttagtttaatacgttacgtaacaaacttaaattaattaagtttaactacgtttacggtacggtacgttacggaaccgtaaagggactaaggtacgtataagtaacgaagacgtaacgtgtcgactacgac

SEQ ID NO: 431053 - DNA, 613 bp, Homo sapiens
  misc_feature: GZ8MTXP02INSI9.19.71.G05.1.454.CMB.2.raw
  modified_base (320)..(320): a, c, t, g, unknown or other
  modified_base (337)..(337): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagtgtgcttggcactgggtcaggcagtccccatcgagaggtctagagtggctggggaagcatatttcatcgtaccaanacgtgaaatacaaattngacaccatctgttgagagttcgactgaacaaagtcaaacgtagaacacgactacgaaacgaaacctagttcctcccctagaccgaagtccgttacgtaacccgttctacgggttaccgacccgttacccccggaaggggtaaccgtaacgggggttacttaacgttaacgtttaaccgtgggttaaacgggaaacggaccggtacccccggtaaataacggtacctaacgtcgtaaccctaaccgtcgttcctaccgtaggttcgtactttaacgg

SEQ ID NO: 431054 - DNA, 627 bp, Homo sapiens
  misc_feature: GZ8MTXP02J3SCK.19.71.G05.1.454.CMB.2.raw
  modified_base (467)..(467): a, c, t, g, unknown or other
  modified_base (509)..(509): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatccgtccggggacagacgtcgctagcgacagtgtgcttggcacgtggtcaggcacgccccagcgagagtcagtacgtggacgtaggggaacgactattatttcacgttacgtacccaaacgtaacggtaggaaaattaactaaaatttcacgacctaaaccctattaccgttaggttaggaacgtacggttacgaaccttagaaacctaagtaaccgaaacggtanaacaacgtataacgaaacgtaaccctacgttcccttacccgngactacgtacgtaccgtaccttcgacggtaccgacccggtaccggacgggtaccgtacggttaacgttaacgttaacgttacgtacggtaacggaaccggacccgtaccctaagtacg

SEQ ID NO: 431055 - DNA, 572 bp, Homo sapiens
  misc_feature: GZ8MTXP02IMYPV.19.71.G05.1.454.CMB.2.raw
  modified_base (222)..(222): a, c, t, g, unknown or other
  modified_base (315)..(315): a, c, t, g, unknown or other
  modified_base (378)..(378): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctntcgctcacctgtcgccatctccggggacagagtcgctagcgacagtgttgcttggcacgtgggtcaggcacgtccccatccgagaggtctagngtggctgggaaggcagtatttcaagtcgtccaaacgacgttagggaaattaccgaaaaatttntagtaccacctaattcctggttagaagtagtccgaactcgaaacaattacaaacgttagaacacatacgaagaacctacgttcaccctgccagctagaccccttgtacgtcgaccgttccggaaacggtacccgaggggttacttactaagtttacctagggttacggaaggaccggaccccctaagttaaccg

SEQ ID NO: 431056 - DNA, 613 bp, Homo sapiens
  misc_feature: GZ8MTXP02GCUWH.19.71.G05.1.454.CMB.2.raw
  modified_base (241)..(241): a, c, t, g, unknown or other
  modified_base (319)..(319): a, c, t, g, unknown or other
  modified_base (435)..(435): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactgcaagtccagccacaatctttanacagttccaacaatagaaaactacttagcttaggtaccagcagacgaccaggacagcctccaggctgctcatttacgngggcatccgacccggggaacgtcccggggtccccctgaccgtattccgagtggcaggcgggtctggggacagtatttcactctcaccatcagcacgcctgcgaggctaggaaagtntaggtggtactagttttagttattacgtaactaaactaatttaatttaacttaattacgtttcggtacggtaaaccggtttccgggaaccccgtaaaaggggtacccgtaaaacggggtacggtaactttaagaacgtaaacggtaacgtaaacgttggtacggtccttacggaaccc

SEQ ID NO: 431057 - DNA, 618 bp, Homo sapiens
  misc_feature: GZ8MTXP02GNGZ1.19.71.G05.1.454.CMB.2.raw
  modified_base (392)..(392): a, c, t, g, unknown or other
  modified_base (452)..(452): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctccacctgtcgccacgtccgtccggggacaggacgtcgctagcgactagtgttgcttggcacgtgggtcaggcacgtccccagtcgaggtaggtctaggagtgggcgtaggggaagactattattcattcgtaccaacgacggtagtaaataactaaattancgacctactattcgtagttagagtagtacgtaactaggaaacaacgtacgaaaacggtanaaccgtaacaacgtaaccggaaaacggtaaaccctaggtttcccctccgtagaccgacgtcctacgtacccttcgtacgtaccgtacccggtacccgaggtaaccggtacggttagttaattaacgttacgagggttacggaacgtaccggacccctaagtaaccg

SEQ ID NO: 431058 - DNA, 541 bp, Homo sapiens
  misc_feature: GZ8MTXP02FGFB4.19.71.G05.1.454.CMB.2.raw
  modified_base (246)..(246): a, c, t, g, unknown or other
  modified_base (259)..(259): a, c, t, g, unknown or other
  modified_base (263)..(263): a, c, t, g, unknown or other
  modified_base (290)..(290): a, c, t, g, unknown or other
  modified_base (323)..(323): a, c, t, g, unknown or other
  modified_base (361)..(361): a, c, t, g, unknown or other
  modified_base (385)..(385): a, c, t, g, unknown or other
  modified_base (426)..(426): a, c, t, g, unknown or other
  modified_base (439)..(439): a, c, t, g, unknown or other
  modified_base (512)..(512): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgagcgggccaccatacaactgacaagtccagccaactaattcttttanactagtaccaaanatanaaaacttctagcttaggaccagcaganaccaggacagcctctaggctgctactattacgngggacagtcgacccgggatccccccggggtcctgactnttcgagtcggcacgggcgggttanagggactaagtactttacacttcaccacagcagacacgccngcgagctagaagngtgtagattagtttatagtatacaaatattatagttatactgtaggtacgttacgaacgacggaacgtaaggngtaataacacgagacgacgtacgagcacg

SEQ ID NO: 431059 - DNA, 589 bp, Homo sapiens
  misc_feature: GZ8MTXP02JU2VW.19.71.G05.1.454.CMB.2.raw
  modified_base (239)..(239): a, c, t, g, unknown or other
  modified_base (251)..(251): a, c, t, g, unknown or other
  modified_base (319)..(319): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccataatcttttanacagttaccaanaatacgaaaacttactagcttggtaccagcagagaccaaggactagcctctaggctgctcatttacgngacactcacgagtacgtccccggtaccagacctagttcgaggtcggccgacggtccgggtacgtaggtactacgttacttccactcacacatcagacacgcgtgacgagtcgtagagtagtgtgtacgttagttattacgttacgtaactaaactaacttaattattaacttacgttacggttacggtacggtacggtaaccgtaaacggtaacgtaacggtaacgtacgtaacgtacgtaacgtaacgtaacgtacgtacgtacgtacg

SEQ ID NO: 431060 - DNA, 557 bp, Homo sapiens
  misc_feature: GZ8MTXP02JR8F7.19.71.G05.1.454.CMB.2.raw
  modified_base (447)..(447): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacaggagtcgctagcgacagtgtgcttggcacgtgggtcagggcagtccccatcggagaggtctaggagtggcgtaggggaggacatatttcattcgtccaaacacgttgggaaataacaaattatagacacctatctgttgagtagtcgactagacaaatacaaagtagaacacagtacgaaacgacctagtttccnccctgccgagaccgtcgaaccctcgtagtcgaccgtccccggaggaaccgtacggggtactattaacgttacgttaggtacgggaacgtaccggaccccctaagtaaccg

SEQ ID NO: 431061 - DNA, 632 bp, Homo sapiens
  misc_feature: GZ8MTXP02IWX1S.19.71.G05.1.454.CMB.2.raw
  modified_base (236)..(236): a, c, t, g, unknown or other
  modified_base (379)..(379): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgaccctctcgctcacctgnccatcgtccgggacaggacgtcgctagcgacagtgttgcttggctacgtgggtcaggcacgtcccagtcgagcggtctagagtggacgtagggaacgactagttattcatcgtacacgtacgtaggaaactaacgtaaattanacgaccacgtattcgtagttagaagtacgtacgtacgtagtaactaaacgtacgtaacgtaacgaactaaacgtaacgttacgaaacgtaaccgtacgttaccctaccgtacgacgtaacgtcgtacgtacccgttacgttacggtaccggtaccgtaacccgggtaaggtaccgttaacggggttagttaacgttaacgtttaaccggttaggtaaacgggtaaccggaccggtacccctaagtaacgaacg

SEQ ID NO: 431062 - DNA, 565 bp, Homo sapiens
  misc_feature: GZ8MTXP02F8HRX.19.71.G05.1.454.CMB.2.raw
  modified_base (268)..(268): a, c, t, g, unknown or other
  modified_base (322)..(322): a, c, t, g, unknown or other
  modified_base (373)..(373): a, c, t, g, unknown or other
  modified_base (409)..(409): a, c, t, g, unknown or other
tcagtactctcgtgcacgaccggtgctcgatttagtgtcgtcgcaagagagaggggggtagggtacaacaggcaggcaggggcagcaagatggtgttgcagacccaggtcttcatttctctgttgctctggatctctggtgcccgacggggacgatcgtgatcgacccagtctccagactccctggctgtgtctctgggcgagcggccaccatcaactgcaagtccagccacaattcttttaatacagttccaaactaatgaaaactnttagcttaggaccagcagagaccaggacagcctctaggctgctactatttacgnggcactaccgtaccggggaatccggggtcccctgaccgattcgagtcggcngggcggtcgtgggacagtatttcactctcacatcancacgctgctaggactagaatagtgtggacttagtttaattagttcgtacaaactaatttaattattattactttacggtacgtacggttacggacccgtaaagggacctaaagggttcgactttagcgaagaacccgtagtcgtacggcttacgac

SEQ ID NO: 431063 - DNA, 688 bp, Homo sapiens
  misc_feature: GZ8MTXP02FX760.19.71.G05.1.454.CMB.2.raw
tcagtactctcgtgcacgaccggtgctcgatttagtgtcgtcgcaagagagagggggggcagagtctgctgaattctggctgaccagggcagtcaccagagctccagacaatgtctgtctccttcctcttcttcctgcccgtgctggacctcccacaaggtgtcctgtcacaagtacagctgcagcagtcaggtccaggactgggtgaacgccctcgcacgaccctctcgctcacctgtcgccagtcgtccggggacagagtcgctagcgacagtgttgcttggcacgtgggtcaggccacgtccccagtcggagaggtctagagtggcgtaggggaaagtacattatttcgaattcgtaccaaacgtaacggtaaggaaaacttaacgtaaaatttactacgtaaccaaccctaaattccgttagttacggtaaggtaacgtaccggtaacttacggaaacctaaaacgtacgaaaaacccggttaggaaaaccctaaacgaaaaccggtaaccggtaaaaaccggtaaacccgttacccgttacccgtacccgttaacgtaccgaaccgtacgttaccctaaccgttcgttacgggtaaccaccccggtacggaacgggtaccgttaacgggtattaattaacgttcggtaggtaacggaaccgacccgaacccgtagtaaaccgg

SEQ ID NO: 431064 - DNA, 606 bp, Homo sapiens
  misc_feature: GZ8MTXP02JUCV1.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcataccctctcgctcacctgtgccatcgtccggggacagagtcgctagcgacagtgtgcttggctacgtgggtcaggcacgtccccatcgagaggtctagagtggcgtagggaagactatatttcattgtccaacacgtaggaaatactaaattatacgacaccatctagtagagacgtcgactgaacactacaaacgtaagacaactagtaacggaaacgtaaaccacgttaccgtaccccgtagaccgtaacggtccttaccggtacccttcgtaacggttccggaaacccgttaccccgggaaaggtaccccggtaacgggggttatttaacgttaacgtttaccgtaggttacggaaaccggtacccggaaccccctagtaaacccgg

SEQ ID NO: 431065 - DNA, 550 bp, Homo sapiens
  misc_feature: GZ8MTXP02IUWN6.19.71.G05.1.454.CMB.2.raw
  modified_base (230)..(230): a, c, t, g, unknown or other
  modified_base (240)..(240): a, c, t, g, unknown or other
  modified_base (318)..(318): a, c, t, g, unknown or other
  modified_base (370)..(370): a, c, t, g, unknown or other
  modified_base (388)..(388): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacgatcaactgacaagtccagccanaattctttanacagttaccaacaatagaaaactactagcttggtaccagacagagaccaggacagcctccaggctgctctatttacgnggcacgtcgtacccgggaatcccggggtcccctgaccgtattcgagtcggcngggcggtctgggacagtntttcactctcacatcagcacgcctgcaggctaggaaatgtgtcggtatagtttattaatcgtacaaataattatttatattagttcgtaggtacgttacggacgtaaaagggacctaagggtgtaacttaagtaacgaagaacgtagtgtacgtactacgac

SEQ ID NO: 431066 - DNA, 835 bp, Homo sapiens
  misc_feature: GZ8MTXP02GWPZN.19.71.G05.1.454.CMB.2.raw
  modified_base (325)..(325): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacaggttgtgcgttggcacgtgggtcaggcacgtccccagtcgaggtaggtctaggngtcggcgtaggggaaagtactattacgttttacagttacgtaccccgtaaaacgtacgggttaggtaaaacttaaactaaaaagtttactaccggacctaaaccctaacttccgttagggtttaggaacgtaaggttcccgaacgttaacggaaacctaaacgttaaccgtaaaaccgggttaaacggaaacctaaaccgtaaacgttaaacccgggaaaaaacggttaaaacccccgttaaacggttttccccctttaaacccccgggtacggtaaacccgtaccggttacccggttaacccggttaaccccgtttcgggttaacccggttaaccccggggttaaacccccggttaaccccggggtaaaacgggggttaaaccccggggttaaaccgggggttttaaacttttaaaacggttaaaacggttttaccggggttaaacggggttaaaccgggggaaaacccggtaaaacccccggggtaaccccgtaaaaacggtaacccg

SEQ ID NO: 431067 - DNA, 589 bp, Homo sapiens
  misc_feature: GZ8MTXP02FS5GP.19.71.G05.1.454.CMB.2.raw
  modified_base (414)..(414): a, c, t, g, unknown or other
  modified_base (435)..(435): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgccagaccctctcgctcacctgtgccatcgtccggggacagacgtcgctagcgacagtgttgcttggcacgtggggtcaggcacgtccccagtcgaggaggtcgtagaggtggacgtaggggaacgtactagttatttcatcgtaccacgacgtaggaaatacgaaattatacgcacctatcgtgttagagtagtacgactanaacgtaatacgaaaccgtaanaaccgaactaacgtaacgaaaccgaaacccgtagttaccctacccgttagaccgtacgctacgtacctcgtacgtcgacccgttccggaacggtacgtacggggtataacgttacgtaacgtaggtacggaacgccggaaccctagtacgaacg

SEQ ID NO: 431068 - DNA, 604 bp, Homo sapiens
  misc_feature: GZ8MTXP02FK091.19.71.G05.1.454.CMB.2.raw
  modified_base (242)..(242): a, c, t, g, unknown or other
  modified_base (314)..(314): a, c, t, g, unknown or other
  modified_base (320)..(320): a, c, t, g, unknown or other
  modified_base (367)..(367): a, c, t, g, unknown or other
  modified_base (423)..(423): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccgatacgaactgcaagtccagccacaattctttanacagttaccaaacaatagaaaactcttagcttggaccagcagagaccaggaccagcctcctaggctgctctntttacnggcatccaccggggatccggggtcccctgaccgattcgagtcgggcncggtcgggtcgtagggactagtatttcgaacttcacaccctatcacgacgacgacncgacgacgacgtagtagagtagtaggtacgtagtttattattacgtactaaactaaattaattaattaacttacgttacggttacggtacggttaccggtaaccggtaaacgggtaaacggtaacggtacggtaagtacgtaacgtaacgtaacgtaacgtacgtacggtacgtacgtacg

SEQ ID NO: 431069 - DNA, 566 bp, Homo sapiens
  misc_feature: GZ8MTXP02JQEZX.19.71.G05.1.454.CMB.2.raw
  modified_base (381)..(381): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgttgcttggcacgtgggtcaggcacgtccccagtcgagtaggtctagagtggcgtaggggaagactattatttcgatcgtccaaacgacggtagaaactaacgaaatttcncgacacattctagtgagtagtcgaactacgaactaacgtacgaaacgtacgacacagtacgaaacgtaactacgttcctacctgacacgcctacgacctcgtcgtacgaccgttacccggacggtaccgacgggttacgtataacgttacgtacggtacggaacggacggaccccgtagtaacgg

SEQ ID NO: 431070 - DNA, 519 bp, Homo sapiens
  misc_feature: GZ8MTXP02I9RLD.19.71.G05.1.454.CMB.2.raw
  modified_base (227)..(227): a, c, t, g, unknown or other
  modified_base (236)..(236): a, c, t, g, unknown or other
  modified_base (414)..(414): a, c, t, g, unknown or other
  modified_base (417)..(417): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagcanaatctttanacatccaacatagaaactactagcttggaccagcagagaccaggacagcctctaggctgctcatttactggcatccgtacccgggaatcccggggtcccctgaccgtattcagtcggcagggcgggtctggggacagtactttcactctcaccatcagcagccctgcaggctagaagntgnggtctagttattatagtacaatattattattatacttcgtagtacgttcggaccgtaaagggacaagggtcgtatagtaacagacgtaactgtcggctgacc

SEQ ID NO: 431071 - DNA, 599 bp, Homo sapiens
  misc_feature: GZ8MTXP02F7W0P.19.71.G05.1.454.CMB.2.raw
  modified_base (205)..(205): a, c, t, g, unknown or other
  modified_base (250)..(250): a, c, t, g, unknown or other
  modified_base (395)..(395): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctgcagaccctctcgctcacctgtcgccatctccgggganagagtcgctagcgacagtgttgcttggctacgtgggtcaggcagtccccatcgagaggtctagagtggcgtaggaggcatattcattgccaacgacgttaggaatacaaattatgaccactatctgttagagtaagtcgacgtanaacaaacgtcaaaagtacgaacaacataccgaaacggaaacctacggttacctaccgtagaccaggtactcggtaaccctcgtcggtacgtacccgtaccgggaacggtaccgtaacccgggggttacttaagttaaacgttaaccggtttaggggtaaccggtaaaacgggtaacccggaccccccgtaaagttaaaacccgg

SEQ ID NO: 431072 - DNA, 572 bp, Homo sapiens
  misc_feature: GZ8MTXP02JSATW.19.71.G05.1.454.CMB.2.raw
  modified_base (283)..(283): a, c, t, g, unknown or other
  modified_base (398)..(398): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagnggtctagagtggcgtaggggaaggactagttatttcattcgtaccaacgacggtaggaaactacaaattatgacaccatctgtagagagtcgatgacaatacgaaacgtagacanagtacgaacgaacctagttcctacccgtgacacgctcgacctcgtcgtacgaccgtaccggaggaccgtacgggtacgttattaagttacgtacggtaggaacggtaccgaccccgtaagtacgaactacgtaccgaaccctaccgttcgtcctcgttcggtactcgtttaacg

SEQ ID NO: 431073 - DNA, 639 bp, Homo sapiens
  misc_feature: GZ8MTXP02H9CIP.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccagggactggtgaagccctcgcagacccctctccgctcacctgtcgccactcgtccggggacagagtcgctagcgacagtgttgcgttggcacgtgggtcaggccacgtccccagtcgagtaggtctagagtggcgtaggggaagacatattcatcgtccaacgtacgtaggaaactacgtaaattactagaccactattcgtagttagaagtagtacggtactaggaaactaatacgtaaaacggttacaaaccaaacgtagtaaaccggaaaacggtaaaccccgtacgtttaccccgtacgtacgacgtacgtaccgtaccgtaccttccggtacgtaccgtaccggtaaccgggaacggtaccggttaacgggttacgttaaacgttaacggttacggtaacggggtaaacggaaccggaacccgtaccgtaaacgtaacg

SEQ ID NO: 431074 - DNA, 571 bp, Homo sapiens
  misc_feature: GZ8MTXP02GKTU2.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacagtgtgcttggcacgtgggtcaggcacgtccccagtcgagaggtctagagtggcgtagggaaggacatatttcatgtccaacacgtagaatactaaattatgacacatcgtagtgagagtcgactgaactaatacaaacgtagacacaatacgaaagaaccgtacgttacctcccgtagactacgacgtcgaacccttcgtcgttacgacccgttacccgacggtaacgtaccgggggtattaacgttaacgttaccgtagggttaacgggaacggtacccgggtaccccctaaggtaaacccg

SEQ ID NO: 431075 - DNA, 599 bp, Homo sapiens
  misc_feature: GZ8MTXP02FPSXD.19.71.G05.1.454.CMB.2.raw
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtcggggacagagtcgctagcgacagtgtgcttggctacgtggggtcaggcacgtccccatcggagagtcgtagagtggcgtaggggaacggactattattcattcgtaccacgacggtaggaaattaacgaaaattatgaccaacctattcttgttagaggtagttacgactagaacaataccaacgtaagaacacaacgtacgaaaacgaaccgtagttaccctcccgtagccgtaaggtcctacgtaacctcgttacggtaccgtacccgtacccggaaggaaccgtacggggttacgttaacttaacgttaacgtaggtaacggaaacggacccggtacccctaagtaacgaacg

SEQ ID NO: 431076 - DNA, 670 bp, Homo sapiens
  misc_feature: GZ8MTXP02IW6NQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgcccagtccgtcccggggacaggacgtcgctagcgacagtgttgcgttggcacgtgggtcaggcacgtccccagtcggagtacggtcaggtaggtcggcgtaggggaagactattatttcagttcgtaccaaacgtacggttaaggaaacttaaacgtaaaatttacgtacgacctaaacctatttccgttagggttaggaaggtacggtaccgtaaacgttaggaaacctaaagtaccaaaacggttaacgaaacctaacgtaacgtaaaccggtaaaacggtaaaccctaacggtttcccctaccccgtaggacctaacggtcctacgtacccttgtacggtacgacccgtaccgggacggtaaccgtacggggttataagttaacgttacgtacgggtacggaaacgtacccggtaccctaagtaaccg

SEQ ID NO: 431077 - DNA, 657 bp, Homo sapiens
  misc_feature: GZ8MTXP02JVGDG.19.71.G05.1.454.CMB.2.raw
  modified_base (250)..(250): a, c, t, g, unknown or other
  modified_base (333)..(333): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtgccatcgtccggganagagtcgctagcgacagtgttgcttggcacgtgggtcaggcacgtccccagtcgagaggtctagagtggcgtagggaacgganattatttcacgtcgtaccactacggtaggaaactaacctaaattatagacctacctaagttcctgttagagtagtacgactagaactaagttaccaaacgtaaacgacttaaaccagttaaccggaaaacgtaacccgtaaacggtttcccctacccgttacgaccgtaaacggttccttaccgggaaacccttccgttacggtaaccggtacccgttacccgggaagggtaacccggttaaccgggggtattaaacgttaacgttaaaccggtgggttaaacggggaaaccggacccggtaccccctaaagtacggtaaaccg

SEQ ID NO: 431078 - DNA, 567 bp, Homo sapiens
  misc_feature: GZ8MTXP02HUW2T.19.71.G05.1.454.CMB.2.raw
  modified_base (223)..(223): a, c, t, g, unknown or other
  modified_base (311)..(311): a, c, t, g, unknown or other
  modified_base (345)..(345): a, c, t, g, unknown or other
  modified_base (391)..(391): a, c, t, g, unknown or other
  modified_base (416)..(416): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctcccacaaggtgtcctgtcacaagtacagctgcagcagtcaggtccaggactggtagaacgccctgcagacccctntcgactcacctgtcgccagtcgtcggggacagagtcgctagcgacgagtgtcgcgttggcacgtggtcaggccagtccccagtcgagngtcgagagtggacgtagggaagactataactttnacgttcgtccaaacgtacgtaggaaataactaatatacgcaaactntacgtagtgaagtagtaccgaatanaacaactacgaaacgtaacaacaactaacgtaacgaaacgtaacgtacgtactacctacgacgtacgtactacgtacgtacgtacgtacgaccgtacgacgtacgtacggtagtagtaacgtacgtacgtacgacgaccgacgtacgtacg

SEQ ID NO: 431079 - DNA, 668 bp, Homo sapiens
  misc_feature: GZ8MTXP02HUJPQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagagtcgctagcgacagtgtgcttggcacgtggtcaggcacgtccccagtcgaggaggtctagagtggcgtaggggaaggacctagtatttacattcggtcccaaacgtacgtaggaaaactaactaaaagtttatcgaccaaccgtaattctaggtttacgaaggttacggtaccgtaacgttacgaaactaaactaaccgtaaaacggttacgaaaccaaacgtaagttaaaccggaaaaccggtaaaacccttacggtttaccctaccccgtaggtcctaaacggtcctaccggtacccttcgttacggttccgaaccgttcccgggaaacgggtaccgtaccgggggtttataacgtttaacgttacgtacgggttcgggaaaacgtacccgggacccctaaggtaaaccg

SEQ ID NO: 431080 - DNA, 643 bp, Homo sapiens
  misc_feature: GZ8MTXP02JCGTN.19.71.G05.1.454.CMB.2.raw
  modified_base (229)..(229): a, c, t, g, unknown or other
  modified_base (239)..(239): a, c, t, g, unknown or other
  modified_base (257)..(257): a, c, t, g, unknown or other
  modified_base (323)..(323): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccanaattctttanacagttaccaactaatanaaaactacttagcttacggaccagtcaagagaccaggacacgcctccgtaggctgctcagtttcgnggctagtcccgtaccggggtaactcccggggtccctacggtaccccgtatttccgaacggtcggacgagggtccggggtcgtacggggaactagtactttcaccgtcttaccaactactacgaacgccgagtacccgcgacgtacggtacgtagaagtgttaggtacggtatttaagtttattacgttacgtaacttaaataatttaatttagttaacgttacgttcggtacggttacggtacggaaccggtaacggtaaacgtacggtacgtaactacgtacggaacgtaacgtacgttacgacggtactacgactacg

SEQ ID NO: 431081 - DNA, 618 bp, Homo sapiens
  misc_feature: GZ8MTXP02I9J71.19.71.G05.1.454.CMB.2.raw
  modified_base (247)..(247): a, c, t, g, unknown or other
  modified_base (320)..(320): a, c, t, g, unknown or other
  modified_base (329)..(329): a, c, t, g, unknown or other
  modified_base (365)..(365): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccgatcgaactgacaagtccagccaactaattcttttaanactagttaccaaacaatagaaaactctagcttaggtaaccagcaagacgaccgagacagcctcgtagctgctntattacggngctacgtaccgaccggtacgtccggtcctacgactntacgagtcgacgcgggtcgggtacgacggactagttcttaccactcctacaactatacgacgactacgctacgacgacgacgagtaagtagtagtacgtacgttagtttattagttacgtaactaactaattaattaattacttacgttacgtacggtacggtacggtaacggtaacggtaaacggtaacggtaacgtaacgtaacgtaacgtaacgtaacgtaacgtacggtacggtacgtacgtacgtacg

SEQ ID NO: 431082 - DNA, 611 bp, Homo sapiens
  misc_feature: GZ8MTXP02JCA5R.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtagaacgcccctcgcacgacccctctccgctccacctgtcgccatcgtccggggacagagtcgctagcgacagtgttgcttggcacgtggtcaggcacgtcccatcgagtaggtctaggagtggcgtaggggaagactagttattcattcgtccaacgtacgtaggtaaataactaaattatcgactacctattcgtagttgaagtacgtcgactagacaaactacaaacgtaagaacacgtaacgtaacggaaacaacctaacgtttcccaccgtcgacctaacggtccttaccggaacccttcggtacggttaccgtaacccggttacccgaaagggtaccgtaacgggttacgttaacgttaagttacgtacgggtacggaacgtaccggacccctaagtaaccg

SEQ ID NO: 431083 - DNA, 654 bp, Homo sapiens
  misc_feature: GZ8MTXP02H77XI.19.71.G05.1.454.CMB.2.raw
  modified_base (240)..(240): a, c, t, g, unknown or other
  modified_base (252)..(252): a, c, t, g, unknown or other
  modified_base (281)..(281): a, c, t, g, unknown or other
  modified_base (313)..(313): a, c, t, g, unknown or other
  modified_base (377)..(377): a, c, t, g, unknown or other
  modified_base (435)..(435): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcggccacatcaactgcaagtccagccactaattcttttanacattaccaaanaatgaaaactatagcttggaccagcaganaccaggacagcctcaggctgctctatttacgnggctatccgtaaccgggactcccggggtcccctagaccgtattcgaggtggcagggcggtacgnggggacagtactttcactctaccacctatcgacgcacgcctgacgacggactggaaancgtaggttcgggtacttagtttttagttaacttcggtaactaaactaattttaaacctttagttttaaactttacgttaccgggtttacgggttaaccgggtttaccggggaaaccggtaaaaccgggggaccggttaaaacggggttaggtaaccttaagttaaccgaacggtaaaaccggtaaccggttaggtcggggtactttaccgggtaaaccc

SEQ ID NO: 431084 - DNA, 667 bp, Homo sapiens
  misc_feature: GZ8MTXP02IIKOP.19.71.G05.1.454.CMB.2.raw
  modified_base (223)..(223): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgagccctgcacgacccctntcgctcacctgtcgccatccgtccggggacaggacgtcgctagcgacagtgttgcgttggcacgtgggtcaggcacgtccccagtccgagtacggtctagaggtcggcgtaggggaagtactagttacgtttcagttcgtacccaaacgtacggtaggaaacttaaccgtaaaagtttactcgaccacctattcgtagttaggaagtacgtaccgacttacggaaactaaactacgtaaaacgttaacgaaaccaccgtaagttacccggaaaacgtaaaccctgttaccctccccgttaggaaccctacggtacctacgtaaccccttacggtacggtaccggaaacccgtacccgggaaacgggtaccgtaacggggtttattaaacgttaagtttacggtacgggtacggaaaccgtacccggtaacccctaaggtaaccg

SEQ ID NO: 431085 - DNA, 556 bp, Homo sapiens
  misc_feature: GZ8MTXP02IIN79.19.71.G05.1.454.CMB.2.raw
  modified_base (312)..(312): a, c, t, g, unknown or other
  modified_base (377)..(377): a, c, t, g, unknown or other
  modified_base (407)..(407): a, c, t, g, unknown or other
  modified_base (424)..(424): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccagtccgtccggggacagagtcgctagcgacagtgttgcgttggcacgtgggcaggcacgtccccagtcgagnggtctagagtggcgtagggaagtactagtatttcattgtaccaatacgtagaaataacaaattancacactatcgtagtagagtagacatagaanaataacgtaaacgtaanacactaagtaacgaacgaacgtacgtacctcctacgacacgtacgtacgtacgtacgtcgtacgaccgtaccgacggacgtacggtaagtagtaacgtacgtacgtacggaacgaccgtaccgaacgtaacg

SEQ ID NO: 431086 - DNA, 669 bp, Homo sapiens
  misc_feature: GZ8MTXP02GQ9L6.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatcgtccggggacagagtcgactagcgacagtgttgcttggcacgtgggtcagggcagtccccatcgagaggtctagaggtggctaggggaagactattattcattgaccaacgacgtaggaataactaaattatgacaccgattcgtgtgaagtagtacgactagaactaaactacgtaaacgtagaacaacgtaatacggaaacgaacctaagtttaccctacccgttcgaccgtaacggtcctacgtaacccgttgttaccgggtacgtaaccccgttaacccgggaacggggtaacccggtaaaccggggttagttaagtttaaacgtttaccggttaggttaacggggaaaccggttacccgggaccccctaaagttaaccggaaactaacgtcggaacccctaccgttaccgttacgtacggtcggtttacgtaccgtttaacggg

SEQ ID NO: 431087 - DNA, 765 bp, Homo sapiens
  misc_feature: GZ8MTXP02JIKY0.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtcgtcctgtcacaagtacagctgcagcagtcaggtccaggactggtagaacgccctcgcacgaccctctcgctcacctgtcgccacgtccggtccggggacaggacgtcgacgtaggacgacgtaggttgttcgcgttcggccgtacggtggggtacgacggccgtaccgtaccccaggtaccggaagggtacggttacgtaagggacggtgggacggtaggggaaacggtaactatttactttacgagttaccgtaaccgaacgtaaccgggttaaggtaaaacttaaacctaaaagtttacgtacgaccctaacctagttacgttaggttaggtaacgtaacgtacgtacgtaacgtaaaccgtaaacgtaaccgtaaaacgtaaacgaaacctaaactaaacgtaaacgaaaaccgtaaacccgttaccgttaccctacccgtacgacgtacgtccgtaccgtaccgtacgttacggtaccggtaaccggttacccgggaacggtaaccggttaacggggttaacggttaacgtttaacgtttaacggtacggggttaaacgggtaaaccggaacccggtacccccgtaaagtaaaccgtaaaccg

SEQ ID NO: 431088 - DNA, 725 bp, Homo sapiens
  misc_feature: GZ8MTXP02HV3FM.19.71.G05.1.454.CMB.2.raw
  modified_base (320)..(320): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctctcgctcacctgtgccatctcgtggggacagacgtcgctagcgacagtgtgcttggctacgtggtcaggcacgtccccagtcgagacggtctaaggnggtggccgtggggaaaggactaagttatttcaagttcggtacccaaacgtaccggtagggtaaaattaaaccgtaaaatttacgtacgtaccctaaacccgtaacgtttccgttagggtttacggtaaaggttaacggttacggaacgttacggaaactaaaacgtaccgtaaacggttaaacggaacctaaacgtaacgttaacccgggaaaactaaacccgtaacggtttccctaccccgttaggtacccaacggttacccgtacgtaacccgttcggttacggttaccgtaaacccgttaccccgggaacgggtaacccggtaaccgggggtttacgttaaagtttaacgtttaacggtacggggttaacgggaaaccggaaccgggtacccccctaaaagg

SEQ ID NO: 431089 - DNA, 563 bp, Homo sapiens
  misc_feature: GZ8MTXP02F0X73.19.71.G05.1.454.CMB.2.raw
  modified_base (247)..(247): a, c, t, g, unknown or other
  modified_base (325)..(325): a, c, t, g, unknown or other
  modified_base (432)..(432): a, c, t, g, unknown or other
  modified_base (442)..(442): a, c, t, g, unknown or other
  modified_base (535)..(535): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagacctcccgtggctgtgtctcgtgggcgagccgggccaccatcaactgacaagtccaagccaactaatcttttaanactagttaccaaacaatagaaaactactagcttgaccagcagagaccaggacagcctacgtagctgctctatttacgngggcacgtccgtaacccggggtaacgtcccccggggtccctcgaccgtattcgaagttggcgagcgggtctaggggactagtactttcactctcacctatcagcacncctgcgacgntagaagagtgtagcttaagtttaattagttatacaaatattaattattatacttggtagtacggttacgaccgaacggtaccgaaggtagtanaatacgagaacgtacgtaggacgctacg

SEQ ID NO: 431090 - DNA, 587 bp, Homo sapiens
  misc_feature: GZ8MTXP02IQ0UU.19.71.G05.1.454.CMB.2.raw
  modified_base (241)..(241): a, c, t, g, unknown or other
  modified_base (319)..(319): a, c, t, g, unknown or other
  modified_base (358)..(358): a, c, t, g, unknown or other
  modified_base (370)..(370): a, c, t, g, unknown or other
  modified_base (378)..(378): a, c, t, g, unknown or other
  modified_base (395)..(395): a, c, t, g, unknown or other
  modified_base (403)..(403): a, c, t, g, unknown or other
  modified_base (433)..(433): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccaccatcaactgacaagtccagccacaatcttttanactagttccaaacaatagaaaactactagcttaggaccagcaagagaccagacagcctacgaggctgctacatttacngggcatccgtacccgggatcccggggtcccctagaccgnttaccaggtgcnggcgggtntgggacagtattcaacnctacaccntcaagcacgcctgcgtaaggctagaaagtntggtgtagttagtttattatcgtaacaaattaaattatttaaatttactaacgttccggttaggaccgtttcggaacccgtaaaagggaccctaaggggtagtacttaagtaaccgaaagtaacgtaaaccttggtccggactttacggaaccc

SEQ ID NO: 431091 - DNA, 690 bp, Homo sapiens
  misc_feature: GZ8MTXP02H5R5O.19.71.G05.1.454.CMB.2.raw
  modified_base (229)..(229): a, c, t, g, unknown or other
  modified_base (605)..(605): a, c, t, g, unknown or other
  modified_base (653)..(653): a, c, t, g, unknown or other
  modified_base (687)..(687): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcgaggtccaggactggtagaacgccctcgcacgaccctcnccgctcacctgtcgccctacgtccggtccggggacacggacgtcgctaacggcgacgtaggtcgttgccgtttgggctacggtgggtcgacggaccgaccgtcccccgagtaccgggaaggtacggtacgtagggaagggttcggggacggtaggggaaacgggtaacctaaagtttacgttttacgaacgttaccggtacccaaacgggtaaacgttaagggtaaaacttaaacgtaaaacgttactacgaaccctaaacctgtttacgtaggtttaaacggaggttaacgtaccggtaaactaacgaaaccttaaagtaaccgaaaacggttacgaacctaaagaacgtaacgaaacgaacttacgtcctaccngacgacgtctcgactcgacgttccgaccgtccggaggaccgtacggtntacttaacgtgtacggacgaaacgccgaccctanacg

SEQ ID NO: 431092 - DNA, 648 bp, Homo sapiens
  misc_feature: GZ8MTXP02INFRO.19.71.G05.1.454.CMB.2.raw
  modified_base (300)..(300): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatccgtccggggacagacgtcgcgtagcgactagttgttgcgttggctacgtgggtcnggcacgtccccagtcgagtagtctagagtggcgtaggggaagctattatttcgattacgtaccaaacgtacggtaaggaaacttaaacctaaagtttacgtcgaacctacctaagttcgtagttagagtacgtacgactacggaactaactacgaaaacgtacaaaccgactaaagtaacgaaacggtaaaccctcggttacccttaccgacgacctaggtccctaacggtaccttcgtacggtaccgtaaacccgtaccgggaaacgggtacccgtaaggggtttacttaacggttaagttacggtacggtaacggggaacgtaccccggtaccccttaagaaccgg

SEQ ID NO: 431093 - DNA, 551 bp, Homo sapiens
  misc_feature: GZ8MTXP02J0L6V.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccagtcgagaggtctaggagtgggacgtggggaaggactattatttcattgtccaaagacgtaggaataacaaatttatcgacacctatcttgttagagtacgtacacgtagacaactacaaacgtagaccacagtacgaaacgaacctagttcctacccgtagccaggcctacgaccttcgtgtcacgtccccggaggaccacggggttatagtaacgttagtcggtaggaaccgcggtaccccagtaacg

SEQ ID NO: 431094 - DNA, 724 bp, Homo sapiens
  misc_feature: GZ8MTXP02FVBXG.19.71.G05.1.454.CMB.2.raw
  modified_base (247)..(247): a, c, t, g, unknown or other
  modified_base (332)..(332): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtggggcgaggccgggccacgatacgaactgacaagtccagccataattctttaanactagttaccaaactaatagaaaactcgttagcttaggaccagacagagaaccaggacagcctcgtaggctgctcatttaccggnggactacgtacccgtaaccgggtaccgtcccggggtacccctacgtaccgtagttcgaggtcggacgtaggggccgggttacggtacggggactacggttactttaccacctacctaccaaccgtactacgacgtaccgacgccgtacgacgtacgacgtagtaagtagtaggtacggtacgttaagtttaagtttaacgtttaacgttaaacgttaaaacgttaaactttaaagtttaaacgtttaacgtttaacgtttaacggtttaccgggttaccgggttaaccgggttaaaccgggtaaaccggggtaaaccggtaaacgggtaacggtaacgtaacgtaacgtaaacggtaacggtaacggtacggtacggtacggtacgtaaccg

SEQ ID NO: 431095 - DNA, 644 bp, Homo sapiens
  misc_feature: GZ8MTXP02HI17T.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcactgtcgcctatcgtccggggacagacgtcgctagcgactagtgttgcgttggctacgtgggcaggcacgtccccagtcgaggtacgtcgtaggagtggcgtaggggaacgtactattactttcacgttcgtacctaaacgtacggtaaggtaaaacttaaccgtaaaatttacgtacgacctaacgtaattcgtagggtttacgaaaggtacgtaccggaacttacgaaactaactacgaaacgtagaaccaactaacgtacgaaaacgtaaccctagttccctaccgtgactacggtcctaacgtaccgttcgtcggtaccgtaacccggtaccggacggtacccgtacgggttataacgttaagttaccggtagggttaacgaaccggtacccgtacccgtaataaccg

SEQ ID NO: 431096 - DNA, 675 bp, Homo sapiens
  misc_feature: GZ8MTXP02IQ4UE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctctcgctcacctgtcgcctactccgtccggggacagacgtcgctagcgactaggttgttcgcgttggctacgtgggtacaggccacgtccccagtcggagtacggtactagagtcggacgtaggggaaaggactaagttactttacgacttcgtacctaaacgtaacggtaggtaaacttaaacgtaaaatttacgtacgaccctaaaccgtagttacgttaggttagtaacgtacgttacggtaacttaacgaactaaacgtacgtaaacggtaacaaactaaccgtaagtaaccgtaaaacgtaacccgtacggttaccctaccgttacgacgtacgtacgtacgtacccgttctcggtaaccgacccgtacccgggtaagtaccggtacggttagttaacgtaacgttacgaggttacgggaaccgacccggtaacccgtaagtaaccgg

SEQ ID NO: 431097 - DNA, 522 bp, Homo sapiens
  misc_feature: GZ8MTXP02FQG1B.19.71.G05.1.454.CMB.2.raw
  modified_base (414)..(414): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagaggtctagagtggctaggggaagacattatttcattcgtccaaagacgtaggaaataacaaattatgacaccatcgtgttgagagtcgactagacaaagtcaaacgtanacgacatacgaaagaacccagttcctccctgcagctgacctcgtgtcgacctccgacgacgacgggtactagtaagttacgtgtacggaacgacggaccccagtaacg

SEQ ID NO: 431098 - DNA, 795 bp, Homo sapiens
  misc_feature: GZ8MTXP02IY7AH.19.71.G05.1.454.CMB.2.raw
  modified_base (240)..(240): a, c, t, g, unknown or other
  modified_base (313)..(313): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcaactgacaagtccagccaacaattctttanacagttaccaacaatagaaaactactagcttggaccagcagacaccagacagcctcgagctgctcatttacgnggctaacgtccgtaaccggggtaactcccggggtccccctaggaacccgtactttccgaaggttcggggacctacgggggtccgggggtcttacgggggaaaccttaacgggttaaccttttccgtaaccctttacccgttacccgaaacccctaaacttcccggaaacgtcccgaaacgggttccccttacggggaccgtaaacggggcccgttaaggaaaccggtaaggtttggtaccgggtacgttaaaggttttttaatttaacgtttacggttaacccctaaaaagttaaacttttaaatttaaacgtttttaaacttacccggttttaaccgggttaggggtttaaacccggtttccgggtaaaacccgggtaaacgggggtaaacccgttaaaagggggttacgtaacgttaaacgtaaccgtaaaggggtaaaccccgtaaacggtagggtcggtaccgtttacggtaaccccg

SEQ ID NO: 431099 - DNA, 619 bp, Homo sapiens
  misc_feature: GZ8MTXP02FLLAI.19.71.G05.1.454.CMB.2.raw
  modified_base (227)..(227): a, c, t, g, unknown or other
  modified_base (236)..(236): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (271)..(271): a, c, t, g, unknown or other
  modified_base (300)..(300): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccanatctttaanacatacaanatanaaactntanctagacagcaganacagacagcctcgagctgctatattacgnggctagtaccgtaccgggacgtcccggggtaccacgaccgtatcgaggtcggacgacgggtcgggtcgtagggactagtactttcacttctacactactacacgctacgcgtcgacgacggtacgtaagaaggtagttcgggtaggtacgttaagtttattaacgttacgtaacctaaacttaaatttaagtttaattacgttacgttcggtaacggttaccggttaccgggaaccggtaaacgggtaaaccgtaaggtacggtaactaacgtaacgaacggtaacgtaacggttcggtacggtacgtacgacctaacg

SEQ ID NO: 431100 - DNA, 654 bp, Homo sapiens
  misc_feature: GZ8MTXP02G3ULA.19.71.G05.1.454.CMB.2.raw
  modified_base (244)..(244): a, c, t, g, unknown or other
  modified_base (464)..(464): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccggccacatcaactgacaagtccagccaactaattcttttaanactacgttaccaaactaataacgtaaactactagtcgttacggaaccagacaagacgaccagacacgtcctacgagctagctactactttacgcggactaacgtacccggtaacccggggtacggtccccgggtacccctacgaccgtagtacgaggtacggcgtgggtccgggtgtacgggactagttacttccactccaccaactatacagcacgccngacgagactaagaagtgtggtagtacttaagtttacttataagtaactaaattaaatttaatttaattaacgttacggtttacggttacggttaacccggttacggaaaccggtaaacgggtaaacggtaacggtaacgtaataacgtaacgtaaacgtaacggtaacgttggtacgtaccgtacgtacc

SEQ ID NO: 431101 - DNA, 523 bp, Homo sapiens
  misc_feature: GZ8MTXP02IVVN5.19.71.G05.1.454.CMB.2.raw
  modified_base (227)..(227): a, c, t, g, unknown or other
  modified_base (234)..(234): a, c, t, g, unknown or other
  modified_base (236)..(236): a, c, t, g, unknown or other
  modified_base (240)..(240): a, c, t, g, unknown or other
  modified_base (242)..(242): a, c, t, g, unknown or other
  modified_base (244)..(244): a, c, t, g, unknown or other
  modified_base (248)..(248): a, c, t, g, unknown or other
  modified_base (250)..(251): a, c, t, g, unknown or other
  modified_base (256)..(257): a, c, t, g, unknown or other
  modified_base (283)..(283): a, c, t, g, unknown or other
  modified_base (291)..(291): a, c, t, g, unknown or other
  modified_base (322)..(322): a, c, t, g, unknown or other
  modified_base (330)..(330): a, c, t, g, unknown or other
  modified_base (336)..(336): a, c, t, g, unknown or other
  modified_base (358)..(358): a, c, t, g, unknown or other
  modified_base (365)..(365): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggcacgatacgactgactaagcagccanatcttanantcanananaatntnntgacnncagacacagacagcctcagctgactntattacgngacacgtcgtacggactccggtcctagactntcagtgcngcggtnaggatagtactcactcacacanacacgcncgtacgtacgacgacgacgtagaagagtagtagtacgttagttattacgttacgtactaataattattattattacgttagtacgtacgtacgtacggtaacgtaacgtaacgtacgtacgtatacgaagacgtacgtacgtacgtacgtacgactac

SEQ ID NO: 431102 - DNA, 571 bp, Homo sapiens
  misc_feature: GZ8MTXP02FXUTP.19.71.G05.1.454.CMB.2.raw
  modified_base (239)..(239): a, c, t, g, unknown or other
  modified_base (263)..(263): a, c, t, g, unknown or other
  modified_base (307)..(307): a, c, t, g, unknown or other
  modified_base (315)..(315): a, c, t, g, unknown or other
  modified_base (355)..(355): a, c, t, g, unknown or other
  modified_base (366)..(366): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaattctttanacagttaccaaacaatgaaaactnttagcttggtaccagcagacgaccaggacagcctcaggctgctnatttacgnggcagtccaaccggggatcccggggtcccctagacccgtnttcaggtcgcngggcggtacgtgggaacctagtactttccgactctcaccatacagcacgccctgcagggtcagaaagtgtggtcgtagttagttttagtattcgtactaaataattaattaccttatacgtttcgtacggtacgtttacggacgtaaacgggaaccgtagggtacggattaagcgaaagaacgtaacgtcgtacggcttcgaacc

SEQ ID NO: 431103 - DNA, 643 bp, Homo sapiens
  misc_feature: GZ8MTXP02G7J3U.19.71.G05.1.454.CMB.2.raw
  modified_base (326)..(326): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgccctcgcacgaccctctcgctcacctgtcgccagtccgtccggggacaggacgtcgctagcgactagtgttgcgttggcacggtggtcaggcacgtccccagtcggagacggtctagnggtggacgtaggggaacgactattattcagttcgtaccaacgtacggtaggaaataactaaagttatcgaccacctagttcgtaggttagagtacgtaccgatacgaactaaagtaccgaaacgtacgaaccaaacgtacgtaaccgaaaacgtaacccttacggttacctaccccgtagaccgtacgtccctacgtacccctttgtacggttaccgacccggttaccccgggaaggtaccgtacggggtttacttaaacgttaacgtttaacgtacggggtaaacggaaccggtacccggtaccccgaagttaacg

SEQ ID NO: 431104 - DNA, 670 bp, Homo sapiens
  misc_feature: GZ8MTXP02GQ747.19.71.G05.1.454.CMB.2.raw
  modified_base (347)..(347): a, c, t, g, unknown or other
  modified_base (623)..(623): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctccacaaggtgtcctgtcacaagtacagctgcagcagtcaggtccaggactggtcgaacgccctgaccacgacccctctccgcctaccacctggtcgcctacgtccggtcccggggaacaggacgtcgacgtacgcgactaggttgttcgcgttggctacgtgggtcaggccacgtcccagtcggagtacggtctaggngtggcgtaggggacgtactagttattcgagttcgtaccgaacgtaccggtaggtaaaacttaacgtaaaatttacgacgtaacctaactagttacgttaggtagtaaaggtccgtttaccgaacgttacggtaaaccaaacgttaacgttaaaaccggacgttaaaccaagtaacgttaaccgaaaacgttaccgtaccgttcccgtacctagtaccaacggtctaccggacccttgtacgtccgaacccgtacgggaacgtacggtaacgggttntaacgtaagttaacgtcggacggaaccgaccggtaccctaataaccg

SEQ ID NO: 431105 - DNA, 618 bp, Homo sapiens
  misc_feature: GZ8MTXP02GO9HF.19.71.G05.1.454.CMB.2.raw
  modified_base (231)..(231): a, c, t, g, unknown or other
  modified_base (239)..(239): a, c, t, g, unknown or other
  modified_base (248)..(248): a, c, t, g, unknown or other
  modified_base (252)..(252): a, c, t, g, unknown or other
  modified_base (258)..(258): a, c, t, g, unknown or other
  modified_base (261)..(261): a, c, t, g, unknown or other
  modified_base (311)..(311): a, c, t, g, unknown or other
  modified_base (374)..(374): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccgatcaactgacaagtccagccanatctttanacatacaanatanaaactntanctagacagcagacgacgagacacgcctcgtagctagctactagtttacgnggtactacgtaccgtaccggtaacgtcccgggtacccctacgaccgtattacgaggtcggacngggtcgggtacgtacggactagtactttacactctacaccatacacgcacgcgtacgacgacgtagtagaagtagtagtaggtagttagtttatttattacgtaactaaactaaatttaatttaattaacgttacgttacggttacggtaacggttaccggtaaccggtaaacggtaaaccggtaaacggtacggtaagtaagtaacgtaacgtaacgtaacgtaggtacggtacgtacgtacg

SEQ ID NO: 431106 - DNA, 606 bp, Homo sapiens
  misc_feature: GZ8MTXP02HXA2F.19.71.G05.1.454.CMB.2.raw
  modified_base (251)..(251): a, c, t, g, unknown or other
  modified_base (338)..(338): a, c, t, g, unknown or other
  modified_base (473)..(473): a, c, t, g, unknown or other
  modified_base (477)..(477): a, c, t, g, unknown or other
  modified_base (592)..(592): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgagccggccaccatcaactgacaacgtccacgccaactaattcttttaanactacgttaccaaacaataagaaaactacttagcttggaccagacagacgaccaggacacgcctacgaggctgactctaatttacgnggactagtacccgtacccggggaacgtccccggggtacccctacggtacccgtattcgagtcgggcacgggggtccgggtcgtagggacctaagtctttaccaccttccaccacccatcaacggcacgctgacgngacngaaagtgtgtgtacgttagttttagatttagactaaatattactttatagtacttggtcggtaacgtcgtaaccggagggtacaggttacgattacgaacgaagacgttaacggnggtacgtactacgc

SEQ ID NO: 431107 - DNA, 609 bp, Homo sapiens
  misc_feature: GZ8MTXP02FMNNV.19.71.G05.1.454.CMB.2.raw
  modified_base (237)..(237): a, c, t, g, unknown or other
  modified_base (244)..(244): a, c, t, g, unknown or other
  modified_base (253)..(253): a, c, t, g, unknown or other
  modified_base (255)..(255): a, c, t, g, unknown or other
  modified_base (257)..(257): a, c, t, g, unknown or other
  modified_base (260)..(260): a, c, t, g, unknown or other
  modified_base (264)..(264): a, c, t, g, unknown or other
  modified_base (270)..(270): a, c, t, g, unknown or other
  modified_base (272)..(272): a, c, t, g, unknown or other
  modified_base (295)..(295): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggcctacggactaacggacgtgactaagcagcanatcttanacatacaanananaanatantgacananagacgacagacacactacagctnactactatacgtacgactactaccgtaccggtacgtaccggtaccccgtacgacgtacgtacgtacgtacgacgcggtacggtcgtacggtacgtagtactactactactactacacacacgacgacgactacgacgacgacgtagtaagtagtagtacgtacgttaagtttaacttagttacgtaactaaactaaattaattaattaacttacgttacgtacggtacggtacggtaacgtaaacggtaaacgtaacggtaacgtaacgtaacgtaacgtaacgtaaacgtacggtagtacgtacgtacgtacg

SEQ ID NO: 431108 - DNA, 657 bp, Homo sapiens
  misc_feature: GZ8MTXP02IJ0SP.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagagtcgtagagtggcgtagggaagacattatttacagttcgtccaaacgtacggtaggaaattaacctaaattatacgactaccagttcgtagttagtaagtacgtacgaacgtagaacgaaactacaaaacgttaacgaacaacgtaagtaccggaaacgtaaaccctaacgttacccgtacccttacgaccgacgtaccgtacgtaacccgttcgttacggttaccggtaacccgttacccggaaacgggtaccggtaaccggggtttaacgttaaacgtttaaacgtttaacggttacggttaacggggtaaaacggtacccgggtaacccccgtaaaggtaaaccgg

SEQ ID NO: 431109 - DNA, 607 bp, Homo sapiens
  misc_feature: GZ8MTXP02JBZ86.19.71.G05.1.454.CMB.2.raw
  modified_base (316)..(316): a, c, t, g, unknown or other
  modified_base (324)..(324): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcaacaagtacagctgcagcagtcaggtccaggactggtagaacgccctcgcacgaccctctccgctcacctgtcgccatcgtccggggacaggacgtcgctagcgactagtgtgcgttggcacgtggtacaggcacgtcccagtcgaggnggtctagnggtggcgtagggaagactattatttcaattcgtaccgaaacgtacggtaggaaactaacgtaaatttcacgacctaacgtattacgtgttagaacgtagtcgaactagaaactaacgtacgtaaacgtagaaccaactaacgtaacgaaacgtaacctacgttccctacccgtagtacgactaccgtactaccgtctcggtaccgaccgtaccggaacgtaccgtacgggttactaaattaacgtacggtaggtacggaacgtacccggaccctaagtaaccg

SEQ ID NO: 431110 - DNA, 657 bp, Homo sapiens
  misc_feature: GZ8MTXP02JTMGV.19.71.G05.1.454.CMB.2.raw
  modified_base (485)..(485): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctctcgctcacctgtcgccagtccgtccggggacaggacgtcgcgtagcgacagttgttgcctttggcacgtgggtcaggccacgtccccagtcggaggtacggtctaggacggtggggtcgtacggggaaagtactagttactttcagttcgtacccaaacgtacggttaggaaactaactaaaagtttacacgacccaacctaattcgttaggttacggaagtacgtacgaacttacgaactaaacgttacgaaacggttanaaccacgtaacgtacgaaacgtaaccgtacgtttaccctcccgtgacctacgtcctacgaacccctttgtacggttaccgaacccggtacccggaacggtaaccgtaccggggttaacttaagtaacgtttacgtagggtaacggaacggacccggtacccctaagtaaccg

SEQ ID NO: 431111 - DNA, 687 bp, Homo sapiens
  misc_feature: GZ8MTXP02H84BK.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctgcacgaccctctcgctcacctgtgcccatcgtccggggacagagtcgctagcgacagtgttgcttggctacgtgggtcaggcacgtccccatcggagaggtctagaggtggctagggaaggactatagtttcattcgtccaaacgaacgtacggtaaataaacctaaaattattacgaccctaaacccaattccgttaggtttacggaagttaacggttaccggaacttacggaaaccttaaacgtaaccgaaaaccggttaaggaaaccgaaactaaacgttaacggtaaaaccggaaacccttaacgggtttccctaaaccccgttgggaccttaaacgggccttaccggtaaaccctttcgtaacggtttccgaacccgttaccccgggaaggtaaccgtaccgggggttacgtattaaccgtttacgaggttaccggaaaacggtacccgggtaccccctaagtaaacccgg

SEQ ID NO: 431112 - DNA, 563 bp, Homo sapiens
  misc_feature: GZ8MTXP02FKLI2.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagagtcgctagcgacagtgttgcttggcacgtgggtcaggcacgtccccagtcgagaggtctagaggtggcgtggggaagactattagtttcagttcgtccaaacgtacgtaggaaatacgtaaattatcgacactatctgttagagtagtcgactagaacaactacaaacggtagaacaacgatacggaaacgaaccgtacgttacctacccgtgactagctgtaccctcgtcgtacgacctacccggacggtacgtacgggtgtaagtaacgttacgtggtacggtaacgaccggaccccagtaaccg

SEQ ID NO: 431113 - DNA, 668 bp, Homo sapiens
  misc_feature: GZ8MTXP02HP03P.19.71.G05.1.454.CMB.2.raw
  modified_base (360)..(360): a, c, t, g, unknown or other
  modified_base (402)..(402): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccatcgtccggggacagacgtcgctagcgacagtgtgcgttggctacgtgggtcaggccacgtccccagtcgaggtaggtactaggtaggtcggacgtaggggaaagtactattactttnacttcgtacctaaacgtacgtaggaaacttaacgtaaaattntcgactacctattcgttgtagagtacgtcgaactagaactaacgtaacgaaacgttagaacctaaacgtaacgttaaccggaaaacgtaacccgttaacgtttaccctaccccgtaggacctaacgtcccgttacgaaccccgtttcgtacgtacccggtacccggtacccgggtaacggtaaccggtaccggggtttactaaagtttaacggttaacgtagggtaaacgggaaaccgtccccgggtaacccctaaggttaacccg

SEQ ID NO: 431114 - DNA, 623 bp, Homo sapiens
  misc_feature: GZ8MTXP02J33BX.19.71.G05.1.454.CMB.2.raw
  modified_base (391)..(391): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtcctccagacctcccctggtctgtgtctcgtgggcgagcgggccaccatcaactgcaagtccagcccactaattcttttaatacagttaccaaacaatgaaaactactagtcttggtaccagcagagacccaggacagccctcctaggcctgctactattttaacgtggggccacgtaccgtacccccggggaaacttccccgggggtacccccctggacccgtnttcgaggttggccgagggtccggggttcgtgggggactagtacttttccaaccttcctaccaacccatcagcacgccgtcgcgacggacgtagaagagttaggtgtcgttagtttatttaaattgtactaaactaataattaatttattacttacgtcgtacgtacggtacgaacggaaccgaacggtacggagtagtaacgacgaacgtaacgtagtcgtcgtacgtaccg

SEQ ID NO: 431115 - DNA, 779 bp, Homo sapiens
  misc_feature: GZ8MTXP02F71PU.19.71.G05.1.454.CMB.2.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtggggcgaggccggggccacgtactacgaacctacgtacgaacgtaccacgaccacctaacttactttacttaacacgttacctaaaccaaatacgtaaaactaaacttacgtcttacgggttaccaacgacaacgaacgaaccgaacgaacgacgaccgtcccttacggacgtcgtcctactactttacgtacggtcgtacgtaccgtaccggggtaaaccggtcccggggtcccccggtaccgacggtacgtttacgacggtggtacgacggtcggggtaacgtcgggaacgtacggttactttacgtacctctacccgaccacgttacacggaactgcccgtgcgaacggtaccgtagtaaagtacggtggtaacggttcggttacttttaaacgttttaggtaaccgttacgttaaaaacctaaagttttaacgtttagtttaactttaaccgttcggtttaacggggtacccggtttacgggaaaccccggtaaaaggggtacccgttaaaggtaacggtattaacccgttaaggaaaaccggtaaccggtaaacgttggggttacgcggttaccgtaaccg

SEQ ID NO: 431116 - DNA, 696 bp, Homo sapiens
  misc_feature: GZ8MTXP02HQJLG.19.71.G05.1.454.CMB.2.raw
  modified_base (242)..(242): a, c, t, g, unknown or other
  modified_base (361)..(361): a, c, t, g, unknown or other
  modified_base (529)..(529): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgacaagtccagccaataattcttttanactagttacccaaactaatacgtaaaacttacttagtcttaggtaacccagacaagacgaacccgaaggaaccacggccccttaccgtagggcctaggccttacgtaacgttttaccgnggggtacctacgttccccggtaaaccccggggtaacgttcccccgggggttacccctaggaaccccgtagtttcgacggttggaccgagggtccggggtcgtagggggaacctaggtactttccgacttcctacgacctagtcaacgcacgcctgcgaggctagaagngttcggtgtacgtttagtttatttagttacgtactaaaataattatttaattacttacgtttacgtacggttaccggttaccggaacggtaaacgggtaaccgtaaaggttaggtaacttacgttacgaaggtaaaccgtaacgttggtacggctacggactaaccg

SEQ ID NO: 431117 - DNA, 685 bp, Homo sapiens
  misc_feature: GZ8MTXP02FY4LG.19.71.G05.1.454.CMB.2.raw
  modified_base (586)..(586): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgttgcttggcacgtggtcagggcacgtccccagtcgagaggtctaggagtggctggggaaggactatatttcagtcgtaccaaactacggtaggaaactaacgtaaaatttagtacgaccaacctaattccgttaggttagtaaggtacggttaccgtaaacttacggaaacctaaacgttaccgaaaacggttaacgaaaccaaacgtaaacgttaaccggaaaacggtaaaccctaacggtttccctaccccgttacgaccgtaacggtccgtaccggtaaccctcgttacgggtacgtaacccgttccccgggaaggtaccgtaaccgggggttntaacgttaacttacggtggttaacgggaaacgtccggaccccctaataacgacactcggaaccctaccgtcgtcctacgtcggtacgtactttaacggg

SEQ ID NO: 431118 - DNA, 608 bp, Homo sapiens
  misc_feature: GZ8MTXP02JTMG9.19.71.G05.1.454.CMB.2.raw
  modified_base (240)..(240): a, c, t, g, unknown or other
  modified_base (448)..(448): a, c, t, g, unknown or other
  modified_base (474)..(474): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccacggggacatcgtgatgacccagtctccagactccctggctgtgtctcgtgggcgagcgggccaccatcaactgcaagtccagccacaatcttttanacagttaccaaacaatagaaaactacttagcttggaccagcagacgacaggacagcctccgaggctgctcatttacgggcactccgtaacccgggatcccggggtcccctgaccgtattcgaggtcggcgaggtccgggtacgtggggaccagtactttacaccgtcctacacccatcgagtcacgccctgaccgtggactagaaagnttggaggtactagtttattatcgtanaaaacgttattatttaattacttaacgtttcgggtaacggtaccgtttacggacccgtaaaagggaccgtaaaagggtcggtaactataaccgtaacggaaccggtaacgtttggacggttccttacggaaccc

SEQ ID NO: 431119 - DNA, 663 bp, Homo sapiens
  misc_feature: GZ8MTXP02H9VZY.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctgcagaccctctcgctcacctgtgccatcgtccggggacagagtcgctagcgacagtgttgcttggcacgtggtcaggcagtccccagtcgagaggtctaggagtggcgtggggaagactagttatttcgatcgtacccaaacaccgtagggaaaacttaacaaaagtttactcgtacaacctattacttaggttaggaagtagtaccgaactacggtaacaaactacgtaaaaccgttaagaaccgtaacaacgttaaccgaaacgtaaaacccgtacgtttacccgtacccgtacgaccgtaggtaccgttcggtaaacccgttaccgttggtaccggtaacccggttaccccgggaaacgggtaccggtaaccgggggttagttaacgttaacgtttacggttacggttacggggaaaacggtacccgggacccccaagttaaaccgg

SEQ ID NO: 431120 - DNA, 515 bp, Homo sapiens
  misc_feature: GZ8MTXP02JCUFL.19.71.G05.1.454.CMB.2.raw
  modified_base (225)..(225): a, c, t, g, unknown or other
  modified_base (234)..(234): a, c, t, g, unknown or other
  modified_base (310)..(310): a, c, t, g, unknown or other
  modified_base (356)..(356): a, c, t, g, unknown or other
  modified_base (413)..(413): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcctgatgacccagtctccagactccctggctgtgtctctgggcgagcgggccaccatcaactgcaagtccagccanaatctttanacagttccaacaatgaaaactacttagcttaggtaccagcagagaccaggacagcctactaggctgctcatttacngggcatctaccgggatccgggtcctgaccatcagtgcagcgggtcngggacagtattcactctcacatcagcagctgcaggctgagagtgtgctagtttattnttagctaacaattattaacttatacttgtaggtacgttacggacctaaacgggacctaaggtgaactatacgaagtaacgtaactggagtctacgactaacc

SEQ ID NO: 431121 - DNA, 631 bp, Homo sapiens
  misc_feature: GZ8MTXP02IGYRI.19.71.G05.1.454.CMB.2.raw
  modified_base (598)..(598): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctctcgctcacctgtacgcctagtccgtaccggggacacgacgtcgctaggcgacaggtgttgcgttggcagtgggtcaggccacgtccccgatcggaggtaggtctaggacggtggcgtaggggaagactattacgttcaagttcgtaccaaacgtacgtacggtaaaactaactaaaagttagtacgacctaaccagtttcgtagtttagaagtacgtaccgtaatacgaaactaactacgaaacgtagaaccaacgtacgtacgaaacgtaaacccttacgttaccgtacctcgtacacggtctacgtacccgttgtacgtaccgtaccttacccgggaagtacccgtaagggttctaacgttaacgttaacgnggttacggaaacgtcccgaacccgtaagaaccg

SEQ ID NO: 431122 - DNA, 673 bp, Homo sapiens
  misc_feature: GZ8MTXP02ICBJ3.19.71.G05.1.454.CMB.2.raw
  modified_base (224)..(224): a, c, t, g, unknown or other
  modified_base (273)..(273): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctntcgctcacctgtcgccagtccgtaccggggacagacgtcgctagcgacngtgttgcttggctacgtggcaggcacgtcccatcgaggtggtactaggagtcggcgtaggggaagtactagttacttcgagttcgtaccctaaacgtacggtaggtaaaattaaaccgtaaaatttactacgaccctaaccctaagtttcgtagttaacggaagtaacggtcgaaacttcggaaaactaaacgtaccgtaaacgttacggaaacctaactaagttaaacccggaaaacgtaaaccgttcgtttaccctacccgttaggacctaaggtccttacggtaaccccttggttacgaccggtacccgttaccgggaacggtaccgtacggggttacttaaacgttaacgttaccgttaggggacggaaaccgtcccggtacccttaggtaaaccg

SEQ ID NO: 431123 - DNA, 526 bp, Homo sapiens
  misc_feature: GZ8MTXP02JI7Q3.19.71.G05.1.454.CMB.2.raw
  modified_base (235)..(235): a, c, t, g, unknown or other
  modified_base (303)..(303): a, c, t, g, unknown or other
  modified_base (309)..(309): a, c, t, g, unknown or other
  modified_base (335)..(335): a, c, t, g, unknown or other
  modified_base (414)..(414): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccaggggacatcgtgatgacccagtctccagactccctggctgtgtctctgggcgagcgggccaccatcaactgcaagtccagccacaattctttanacagttaccaacaatagaaaactacttagcttggtaccagcaagagaccagacagcctcaggctgctnattacnggcatcgtaccggaatccggggtccncgacgtattcagtgcagcgggtctaggggacctagatttcactctacaccatcagcacgcctagcaagctagaagtacngtaggactagtttattactgactaataattattaagttatacgttgtagtaacgttcgactaacgggacaaggtcgaatctagaagtaacgagttcgacgctacgactaacg

SEQ ID NO: 431124 - DNA, 644 bp, Homo sapiens
  misc_feature: GZ8MTXP02IG62A.19.71.G05.1.454.CMB.2.raw
  modified_base (251)..(251): a, c, t, g, unknown or other
  modified_base (348)..(348): a, c, t, g, unknown or other
  modified_base (395)..(395): a, c, t, g, unknown or other
  modified_base (498)..(498): a, c, t, g, unknown or other
  modified_base (606)..(606): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccgatacaacgtgacaacgtccagaccaactaattcttttaanactacgttaccaaactaataacgtaaaacttactagtacttacggtaccagaccagaacgaccgaaggacacgccctctaggctgctctatttacgnggacacgtaccgtaccgggacgtcccggggtacccctaggacccgtnttacgaggtcggaccgtaggggccgggttacgtacggggactaacggttactttaccaaccgttcctaccgaacccgtactaccgaacgacccgacgtcccgngaccgagggtactaaggaaacgtatcggtagtactagttttactagtatacaaatattattaattcgtacgttcgtagtacggttacggactaaacgggactaaggtntaatacgaacgagtaacgtacgtagcggacttacgacc

SEQ ID NO: 431125 - DNA, 652 bp, Homo sapiens
  misc_feature: GZ8MTXP02JBPR7.19.71.G05.1.454.CMB.2.raw
  modified_base (469)..(469): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccttgctgggcctcccacaaggtgtcctgtcacaagtacagctgcagcagtcaggtccaggactggtgaacgccctcgcacgacccctctcgcctcacctgtcgcccatccgtccggggacagagtcgctagcgacaggtgttgtcgttggcacgtgggtcaggcacgtccccagtcgaggtaggtctaggagtgggcgtaggggaaacgacgtattactttcgacttcgtccctaaacgaccggttagggaaaacttaactaaaatttagtacgaccacctattcgttggttagagtagtcgtactacgaacaaagtacaaaccggtaaanaaccaactacgtaacgaaacgtaaaccgtacgttaccctacccgtagaccacgtacctacgtaccgttcgtacgtaccgtacccgttacccggaacggtaaccggtaacgggttacgttaaacgttaacgttacggttacgggtaaacgggtaaaccggtacccggtaaccccgtaagtaacg

SEQ ID NO: 431126 - DNA, 657 bp, Homo sapiens
  misc_feature: GZ8MTXP02GX04C.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagacgtcgctagcgacagtgtgcgttggcacgtgggtcaggcacgtccccatcggagaggtctaagaggtggcgtaggggaagacattatttcattcgtaccaaacgtacgtaggtaaactaactaaaatttacgtacgacctaccaagttccttaggttaggaagtaacgtaccggtaagtacggaaactaaacgttaaccgaaaacggttacggaaacgaactaaacgttaaccggaaaacggtaaaccctacggtttaaccctcccgttaggaccaggtacctacgaacccttcgtacgtacgtacccgttacccgggaacggtaccggtaacggggttacgttaaccttaagttaccgttagggtacgggaaacgaccgggtacccccaaagtaacgg

SEQ ID NO: 431127 - DNA, 619 bp, Homo sapiens
  misc_feature: GZ8MTXP02H2ZOH.19.71.G05.1.454.CMB.2.raw
  modified_base (245)..(245): a, c, t, g, unknown or other
  modified_base (259)..(259): a, c, t, g, unknown or other
  modified_base (336)..(336): a, c, t, g, unknown or other
  modified_base (413)..(413): a, c, t, g, unknown or other
  modified_base (420)..(420): a, c, t, g, unknown or other
  modified_base (450)..(450): a, c, t, g, unknown or other
  modified_base (457)..(457): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgagcgggccacgatacaactgacaagtccagccactaattcttttaanactagttaccaaanaatacgaaaacttcttagcttaggaccagcaagacgaccaaggacagcctccgtaaggcctgccttactatttacgngggacacgttacccgacccggggtaagtccccggggtccctaggacccgtattccgaggtcggctggggtcgggtcnggggacngttacttcacttcacacgatcagcagccgngacgagngtagagtagtgtagtagttagtttattattagtactaattaattaattattacttacgttacgttacggttacggttaccggtaacggtaacggtaaacggtaacggtacgtaacgtaacgtaacgtaacgtaacggtacgtacggtacgtacgtacgtacg

SEQ ID NO: 431128 - DNA, 628 bp, Homo sapiens
  misc_feature: GZ8MTXP02GICBU.19.71.G05.1.454.CMB.2.raw
  modified_base (260)..(260): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctccacctgtcgccagtccgtccggggacagngtcgctagcgacagtgttgcttggcacgtgggtcaggcacgtccccagtcgagacggtctaggagtggcgtaggggaagactattactttcgaagttcgtaccaaacgtacggtaaggtaaattaactaaaatttactcgacctaccattcgtagttagaagtagtcgaacgtacgaacaatacgaaacgtacgaacaacgtaagtacgaaaacgtaacctaacgttccctaccgtagacacggtctacgtaccctcgttccggtacgtaacccgtacccggaaacggtaccgtaacggggttacgttaacgttaacgttaccggtaaggttaacgggaaccgtaccgggtacccccaagtaaaccgg

SEQ ID NO: 431129 - DNA, 575 bp, Homo sapiens
  misc_feature: GZ8MTXP02IH1LH.19.71.G05.1.454.CMB.2.raw
  modified_base (242)..(242): a, c, t, g, unknown or other
  modified_base (322)..(322): a, c, t, g, unknown or other
  modified_base (370)..(370): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccactaattcttttanacacgttccaaacaatagaaaactacttagcttggtaccagacagagaccaggacacgcctctaggctgctcatttacgnggcatccgtaccgggatccggggtcccctgaccgtattcgagtcggcnggggtcgggtctaggggacctagtatttcgactcctacaccctatcacgtcacgccctgacagggctagaaagtgtaggtggtacttaggtttattagttacgtactaaatattaatttattacttacgttcggtaggtacgttacggaccgtaaaggaccgtaggtacgtataagtcgaagacgtaacgtggtcgtctacgacc

SEQ ID NO: 431130 - DNA, 596 bp, Homo sapiens
  misc_feature: GZ8MTXP02GMXT7.19.71.G05.1.454.CMB.2.raw
  modified_base (234)..(234): a, c, t, g, unknown or other
  modified_base (312)..(312): a, c, t, g, unknown or other
  modified_base (346)..(346): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattctttanacagttccaaacaatagaaaactacttagcttggtaccagcagagaccaggacagcctctaggctgctctatttacgngggcactccgtaacccggggatccccggggtccngacccgtattcgaggtcggacagggcgggtctggggacagtattcactctacactatcagcacgcctgcagggctagaagtagtggtaggacttagttttattagttgtaacctaaataatttaatttactttaagttaaccgtttcgggtacgggtaacggtttccgggaaccgtaaacggggtaaccgtaaagggttacggaacttacgtacgaaggaacgtaacgtggtacggctacggacctaacg

SEQ ID NO: 431131 - DNA, 660 bp, Homo sapiens
  misc_feature: GZ8MTXP02GQ7YR.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccactcgtccggggacagacgtcgctagcgacagtgttgcgttggcacgtgggtcaggccacgtccccagtcgagtaggtcaggaggtggcgtaggggaaagactaagttagtttacagttcgtaccaaacgtacggtagggtaaaacttaactaaaatttacgtacgacctaactacgttcgttagttagaagtacgtaccggtaactacggaaactaaacgtacgtaaaacgtacgtaaaccgaacgtaacgtaaccgaaaacggtaaccctaacggtttccctacccgtagacctaacggtctaccgtacccttgtaccggtcgtaacccgtacccggaagggtacccgtaggggttacttaagttaacgtttaccgtaggtaaacggaaccggaacccggtaccccaagttaaccgg

SEQ ID NO: 431132 - DNA, 570 bp, Homo sapiens
  misc_feature: GZ8MTXP02JQ1HS.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagacgtcgctagcgacagtgttgcttggcacgtgggtcaggcacgtccccagtcgagtaggtctagagtggcgtaggggagacatatttcattcgtccaacgacgtaggaaatactaaattatcgacactatctagttgagtagtcgatacgactaactacaaacgtagacacaatacgaaacgtaactacgttcctacccgtagacacgtctacgacccttcgtacgtacgaccgtaccggaacggtacgtaacggttacgtaacgttaacgttaccgtaggttacggaacggtaccggacccccgtaagtaaaccg

SEQ ID NO: 431133 - DNA, 699 bp, Homo sapiens
  misc_feature: GZ8MTXP02FZ04J.19.71.G05.1.454.CMB.2.raw
  modified_base (116)..(116): a, c, t, g, unknown or other
  modified_base (241)..(241): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctntctccttcctcttcttcctgcccgtgctgggcctcccacaaggtgtcctgtcacaagtacagctgcagcagtcaggtccaggactgggtgaacgccctcgcacgacccctctcgctcacctgtcnccactccgtcggggacaggacgtcgctagcgactagtgttgcttggcacgtgggtcaggccacgtccccatcggagaggtctaagagtggcgtaggggaacgactagtttacttcagttcggtaccaaacgacggttaggtaaaactaacgtaaaatttacgttacgaccctaaactagttacgttaggttacgtaagtacggtaccgtacgtacgtaaaccaaagttaccgaaacggtaacgaaacctaacgtaacgtaaaccggtaaaacgtaaaccctaccgttaccttaccccgtaggacctacgacctttacggaccctttacggtacgtacgtaaacccggtacccgggaaacgggtaaaccggttaacgggttcgtttaaaacgttaacgttttaaccggtacggttacggggtaaaaccggacccggtaacccccgtaaagttaaaccgg

SEQ ID NO: 431134 - DNA, 603 bp, Homo sapiens
  misc_feature: GZ8MTXP02HEOB7.19.71.G05.1.454.CMB.2.raw
  modified_base (241)..(241): a, c, t, g, unknown or other
  modified_base (329)..(329): a, c, t, g, unknown or other
tcagtactctcgtgcacgaccggtgctcgatttagtgtcgtcgcaagagagagggggggtacaacaggcaggctggggcagcaagatggtgttgcagacccaggtcttcatttctctgttgctctggatctctggtgcccacggggacatcgtgatgacccagtctccagacctccctggctgtgtctcgtgggcgaggccgggccacatcaactgacaagtccagccaataattctttanacagttaccaaacaatacgaaactacttagcgtttacgaccagacagacgaccgaggactacgcctacgtagctgcctatagtttcgngggactagtcccgtaaccggggactcccggggtcctacgaccgtattcgagtcggacacggcgggtctagggacctagtactttccacttcctacgactatcgacgcagtcctagcgtaggctagaagtatgggtacgtacttagtttacttgttacgactaaattattaatttagttacttaccgttaggtacggttacgttaccggaacgtaaacgggacgtaaggtagtaactgtaccgaagaccgtaagtcggtacgactacgacctacg

SEQ ID NO: 431135 - DNA, 636 bp, Homo sapiens
  misc_feature: GZ8MTXP02HIKVX.19.71.G05.1.454.CMB.2.raw
  modified_base (390)..(390): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagacgtcgctagcgacagtgttgcttggcacgtgggtcaggcacgtccccagtcgagtaggtctagagtggcgtaggggaagactagttatttcaagttcgtacccaaacgtacggtaggaaattactaaaagttancgacactagttactggttgagtacgtacgactagaactaactacgaaacgtaacgaacacgaagtacgaaacgtaaacctacgtttcctaccctagctacggtacctacgtaacccttcgtacggtaccgtacccgtacccggggaaacggtaccgggttaacgggttacgttaaacgttaacggtttaacgttacggggttaacgggaaaaccgggtacccggtaacccccgtaagtaaacccgg

SEQ ID NO: 431136 - DNA, 580 bp, Homo sapiens
  misc_feature: GZ8MTXP02G91G3.19.71.G05.1.454.CMB.2.raw
  modified_base (249)..(249): a, c, t, g, unknown or other
  modified_base (272)..(272): a, c, t, g, unknown or other
  modified_base (437)..(437): a, c, t, g, unknown or other
  modified_base (440)..(440): a, c, t, g, unknown or other
  modified_base (495)..(495): a, c, t, g, unknown or other
  modified_base (511)..(511): a, c, t, g, unknown or other
  modified_base (578)..(578): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtggggcgaggccgggcctacgactacgaactgacaagtccagccactaattctttaanacgattaccaacaatagaaactnttagctagtaccagacagagaccaggacacgtcctcgtagctgactctattacgacggctaacgtaccgtaaccggggtacgttcccccggggtaccctagacccggtattaccgaggttcggcgaggtcgggtcgtagggactagtacttcgacttcaccctanacncgaacgcacgcctagcctaggctagagtacgtgtaggtactagtttaatgtacanaatatattacttagtnttacgaggtctacgggacctaaggtacgaaggttgaataacgtacgacgtagtacgtcgtacgtacncg

SEQ ID NO: 431137 - DNA, 613 bp, Homo sapiens
  misc_feature: GZ8MTXP02F6L16.19.71.G05.1.454.CMB.2.raw
  modified_base (243)..(243): a, c, t, g, unknown or other
  modified_base (254)..(254): a, c, t, g, unknown or other
  modified_base (283)..(283): a, c, t, g, unknown or other
  modified_base (312)..(312): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccacgatacgaactgacaagtccagccacattctttanacgattccaanaatgaaaactctagcttggaccagcaganaccagacagctcaggctgctcatttacgngctactcgaccggacgtccggtccctagaccgtatcgacgtcggcgcgggcgggtcgagggactagtacttcactctaccacgtatacgacgacgacgccgtacgacgacgacgtagtaagtagtaggtacggtacgttaagtttaagtttagttacgtaacgtaaacttaaattaaacttaagttaacgttacgttacggttacggtacggttaccggtaaccggtaaacggtaacggtaacggtaacgtaacgtacgtaacgtaacgtaacgtaacgtacggtacggtacgtacgtacg

SEQ ID NO: 431138 - DNA, 560 bp, Homo sapiens
  misc_feature: GZ8MTXP02HC5VR.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgggtgaagccctcgcagaccctctcgctcacctgtgccatcgtccggggacagagtcgctagcgacagtgttgcttggcacgtgggtcaggcacgtccccatcgagaggtctagagtggcgtgggaagacatatttcatgtaccaacgacgtaggaaactactaaattatgacacctatcgtgtagagtagtcgactgaacaatacaaacgtagaacacagtacgaaacgaacctacgttccacctgacagtctacgtacctcgtagtacgacccgtaccggagggacgtacggggtactaagtattacgtaggtacggaacgtaccggaccccaagtacgaactgtacgccctaccgtcgtactcgtcggtcgtacttagg

SEQ ID NO: 431139 - DNA, 550 bp, Homo sapiens
  misc_feature: GZ8MTXP02GN1ZH.19.71.G05.1.454.CMB.2.raw
  modified_base (237)..(237): a, c, t, g, unknown or other
  modified_base (315)..(315): a, c, t, g, unknown or other
  modified_base (352)..(352): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccatcaactgcaagtccagccaactaatctttanacagttaccaaacaatagaaaactattagcttaggtaccagcagagacaggacagcctcctaggctgctcatttacgnggcatccgtaaccgggaatcccggggtcctgaccgtnttcgagtcggcaggcggggtctaggggacctagtactttcaactctacacatcaagcagccctgacagggctagagtagtggtggacttagtttattagttgaacctaaataattattattatcgttagtacgtacgttccggacgtaaacggtacaaggtgactagtacaacgacgtaagtcggagctacgactaac

SEQ ID NO: 431140 - DNA, 569 bp, Homo sapiens
  misc_feature: GZ8MTXP02FRSA0.19.71.G05.1.454.CMB.2.raw
  modified_base (309)..(309): a, c, t, g, unknown or other
  modified_base (366)..(366): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgcccatccgtccggggacagagtcgctagcgacagtgtgcttggcacgtgggcaggcacgtccccagtcgagngtctagagtggctgggaacgactatatttcaatcgtacacgcgtagaatactaaatngacactatcgtgttagagtagtacacgttagaactaatacgaaacgtagaacaacgaacgttacgaaacgtaaccgtagtttaccccgccgtacgacgtacgtctacgtaccttcgtacgtaccgaccgtaccggtaggtacgtacgggttactaacgttacgttaacgtaggtacggaacgaccgtacccgtagtacgtacg

SEQ ID NO: 431141 - DNA, 623 bp, Homo sapiens
  misc_feature: GZ8MTXP02F6FUY.19.71.G05.1.454.CMB.2.raw
  modified_base (433)..(433): a, c, t, g, unknown or other
  modified_base (484)..(484): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtagaacgccctcgcacgaccctctcgctccacctgtcgccagtccgtccgggacagagtcgcgtagcgactgtgtgcttggctacgtggtcgaggcctacgtccccagtacggaggtacggtacgtaggaggtcgggcgtaaggggaaagtaccgtagtttacgtttacacgttcgtacccgaacgtaacggtaaggtaaactaacgtaaaattacgtacgacctaacctnttacgtgttaggaagtacgtacgtaactacgaactaactacgaaaacgtanaaccaactaacgtaacgaaaccgtacctacgttcccaccgtgacacgtctacgtacctcgtacgacgtacccgtacggacggtaccgtacgggttattaactaacgtcgtaggtaacgacgtaccggacccaggtaacg

SEQ ID NO: 431142 - DNA, 611 bp, Homo sapiens
  misc_feature: GZ8MTXP02IRJOJ.19.71.G05.1.454.CMB.2.raw
  modified_base (250)..(250): a, c, t, g, unknown or other
  modified_base (391)..(391): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctccacaaggtgtcctgtcacaagtacagctgcagcagtcaggtccaggactggtgaagccctcgcagaccctctcgctccactgtcgccatccgtccggggacngacgtcgctagcgacagtgttgcttaggcacgtgggtcacggcacgtcccctaatccgaggtaggtacctaggaggttgggacgttaggggaaacgtctaatactttcatcgtaccagtacggtagaaataacaaagttanacgactactatcgtagtagagtagtacgtactacgaactaacgtacgtaacgtaacgacaaactacgtaacgaaacgtaaccgtacgttacccgtaccgtacgacgtacgtacgtaccgtacgtcgtacgtaccgtaccgtaccggtaacggtacgtacgggttacgtaacgttaacgttaacgtaggtacggaacgtaccgtacccgtaagtaacgacg

SEQ ID NO: 431143 - DNA, 698 bp, Homo sapiens
  misc_feature: GZ8MTXP02I6JZX.19.71.G05.1.454.CMB.2.raw
  modified_base (155)..(155): a, c, t, g, unknown or other
  modified_base (225)..(225): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccanaaggtgtcctgtcacaagtacagctgcagcagtcaggtccaggactggtgaacgccctcgcagacccctntcgctcacctgtcgccactcgtccggggacagacgtcgctagcgacacgtgttgacgtttggcacgtgggtcaggcacgtccccagtacgaggtaggtctagaggtcggtcgtaggggaagacgtattacgtttcacgttcgtaccgaacgtacggtacgtaaactaactaaagtttactcggaacctacctagttaccttaggttagaacggtacgtaccgtaacgttacggaaactaacgttaaccgaaaacggttaacgaaacctaacgtaaacgttaacccggaaaacgtaaacccgtaaccggtttacccgtccgtacggacctacggtacctacgtaccccgttgttacggtccggaacgttaccccggaacgggttaccgtaacggggtttacttaaacgttaacgtttaacggttacgggtaacggtaaaccggtacccgggtaccccctaaggttaaaccccgg

SEQ ID NO: 431144 - DNA, 578 bp, Homo sapiens
  misc_feature: GZ8MTXP02GUXKP.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccagtcgtccggggacagacgtcgctagcgacagtgttgcttggcacgtgggtcaggcacgtccccatcgagtaggtcaggagtggcgtaggggaacgactagttattcattcgaccacgacgtaggaaatactaaattagacgacactatctagtgagagtcgactgaactaatacgaacgtaacgacaacgaagtacgaaactaacctacgttacctcccgtagtccacggtcctacgtaacctcgttacgtaccgtaccgtacccggaaggtaccgtacggggttagtaacttaacgttaacgtaggtacggaacgacccggacccctaagtacgtaacc

SEQ ID NO: 431145 - DNA, 590 bp, Homo sapiens
  misc_feature: GZ8MTXP02JWBWC.19.71.G05.1.454.CMB.2.raw
  modified_base (245)..(245): a, c, t, g, unknown or other
  modified_base (361)..(361): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccacgatacgactgacaagtccagcactaatctttaanactataccaataatataaactctagtctacgacagacagacgacgagacacgtcctcgagctgctactattcgcggactacgtccgtaccggacgtccggtccccagacctatcgngtcgcgacggtcggtcgtaggactgtacttaccactacctaccaacgacgcgtacgacgacgccgtacgacgacgacgtagagtagtagtagtagttagttagttattacgtactaactaattaattaattacgttacgttacgtacggtacggtacgtacggtaacggtaacggtaacggtacgtagtacgtaacgacgtaacgtacgtacgtacgtacgtacgtacg

SEQ ID NO: 431146 - DNA, 591 bp, Homo sapiens
  misc_feature: GZ8MTXP02JQJST.19.71.G05.1.454.CMB.2.raw
  modified_base (323)..(323): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagacgtggctgggaaggacatatttcattgtccaacncgtgaactacaaattatagcacatctgttgagtagtcgactagactaaatacaaacgtagaacactatacgaaacgaaacccgtagttacctccctacgacaacgtcctacgtaacccttcttggtacgtaacccgtacccggaagggtaacgtaacggggtagttaacttacgttaacgttgggtaggaacggaccgggtacccccttaagtacggactactacggcccgaaccttccggtctaccgttaggttcgacctttaacgg

SEQ ID NO: 431147 - DNA, 612 bp, Homo sapiens
  misc_feature: GZ8MTXP02HY00Z.19.71.G05.1.454.CMB.2.raw
  modified_base (386)..(386): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccacgtccgtccggggacagacgtcgctagcgacagtgttgcgttggcacgtgggtcaggcacgtccccatcgaggtacggtctaggaggtggcgtaggggaagactagttactttcatcgtaccaagacgtagaaataactaaatntcgactaccattcgtgttagagtagtacgactagaaactatacgaaacgtagaacactaacgtacgaaacgtaacctagttcctacccgtaggcctaacgccttacgtaaccccgttgtacggtaccgaacccgttacccgggaacggtaacccgtacggggttaagttacgttaacgttacggtaacggtacggtaaacggacccggtaaccccgtaagtaaccg

SEQ ID NO: 431148 - DNA, 627 bp, Homo sapiens
  misc_feature: GZ8MTXP02HVK5N.19.71.G05.1.454.CMB.2.raw
  modified_base (294)..(294): a, c, t, g, unknown or other
  modified_base (359)..(359): a, c, t, g, unknown or other
  modified_base (367)..(367): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgaccctctcgctcacctgtcgccatccgtccggggacaggacgtcgctagcgacaggttgtgcgttggcacgtgggtcaggcacgtccccagtcgagngtcagagtggcgtagggaagacattatttcatcgtaccaacgtacggtagaactaacaaaatttngacacgtntctgttagagtagtcactagaacaatacgaaacgtagactacgatacgaaacgaacctacgttcctaccgtgacacgtactacgtaccctcgtcggtaccgacccgtacccggaacgggtaccgtaacggggttcttaaacgtttaacgttaaccggttagggtaacgggaaaccggaacccgacccccgtaaagtaccgactaacgtccgtaacccgtacccgttacgtcctcggttacggtacgtaacctttaacggg

SEQ ID NO: 431149 - DNA, 605 bp, Homo sapiens
  misc_feature: GZ8MTXP02JI0N8.19.71.G05.1.454.CMB.2.raw
  modified_base (313)..(313): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcacgtccccatcgagagtctagngtggctgggaagcatattcatgtccaaacgtacgtagaaataactaaattacagacacctatcgtagttacgaagtagtaccgacgtagaactaacgtacgtaaacgtaacgaactaacgaacgttaccggaaaagtaaaccctaacgtttcctacccgttacgactacgtaccgtacgtaacccttcgttacgtacgtacccgtacccggaacggtaccggtaacgggttagttaacgttaacgttaaccgtaggttaacggaacggtaccggaacccccgtagtaaaccg

SEQ ID NO: 431150 - DNA, 566 bp, Homo sapiens
  misc_feature: GZ8MTXP02I6RZX.19.71.G05.1.454.CMB.2.raw
  modified_base (228)..(228): a, c, t, g, unknown or other
  modified_base (237)..(237): a, c, t, g, unknown or other
  modified_base (248)..(248): a, c, t, g, unknown or other
  modified_base (313)..(313): a, c, t, g, unknown or other
  modified_base (362)..(362): a, c, t, g, unknown or other
  modified_base (426)..(426): a, c, t, g, unknown or other
  modified_base (453)..(453): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaanaatagaaaactacttagcttggtaccagcagagaccaggacagcctcctaggctgctcatttacnggcagtctacccgggatccggggtcccctgaccgtattccgagtcggcnggcgggtctggggaccagtactttcactctacacccatacagccagccctgccaggctgaaagntgtggtctagtttattatgtactaaanaattaattattatacgttggtacggtacgtttacggaccgaaagggtaccgaagggtcggtaaacgttataaccgtaaggaaaccgtaacgttagggtcggtacgtacgtacc

SEQ ID NO: 431151 - DNA, 731 bp, Homo sapiens
  misc_feature: GZ8MTXP02H1TVE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctccacaaggtgtcctgtcacaagtacagctgcagcagtcaggtccaggactggtgaagccctcgcacgaccctctccgctcacctgtcgcctacgtccgtaccggggacaggacgtcgctaggcgactaggtgttgcgttggccacggtcgggtcaggcaccgtccccagtacggagtaggtcgtaaggagtgggacgtaggggaacggtactagttacgtttcagttacgtaccctaaacgtaacgtaggtaaaacttaaacgtaaaattacgtacgacctaactagttaccgttaggttacggaaggtaacgttaccgaacgttaacgtaaacgtaaacgttaaaccgaaacggttaaacgaaaccgtaaacgtaaacgttaaaccggaaaaccgggtaaaccttaacggtttaccctacccgttacggactaaccgtaccgttaccgtaccccgttacggtaccggttaccggaacccgttaacccgggaacggtaaccgtacggggttacttaacgttaacgttaacgtacgggttaacggaaaccggtacccggtaacccccgtaagtaaacccgg

SEQ ID NO: 431152 - DNA, 592 bp, Homo sapiens
  misc_feature: GZ8MTXP02F7DKZ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtgccatccgtccggggacagagtcgctagcgacagtgttgcttggcacgtgggtcaggcacgtccccatcgagaggtctagagtggcgtggggaaaggactatagtttcagttcgtccgaaacacggtaggaaatactaaaattatgacacctatctgttagagtagtcgactagacaatcaaacgtagaacacaatacgaaacgaacctaagttcctacctagcgagtacctacgacccttgtacgtacgtacccgtaccggtaacggaccggtaaccgggttagttaacggttaactttaaccggtagggttaaccggggaaacgtaccggtaccccccgaagttaaacccggg

SEQ ID NO: 431153 - DNA, 678 bp, Homo sapiens
  misc_feature: GZ8MTXP02JQDJE.19.71.G05.1.454.CMB.2.raw
  modified_base (244)..(244): a, c, t, g, unknown or other
  modified_base (256)..(256): a, c, t, g, unknown or other
  modified_base (323)..(323): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccgacggggacatcgtgatgacccagtctccagcctccctggctgtgtctcgtgggcgaggccgggccaccatcaactgacaagtccagccactaattctttanacagttaccaanaatagaaaactacttagcttaggaccagcagagaccaggacagcctccgagctgtctctatttacgnggaccagtccgtaaccccggggtatcccccccggggtcctacgacccgtagttcgacggttggccgtacgggtcggggtcgtacggggactaggtactttacccacttcctaccaaccctagtccaagccaccggttccgacggtacacggggtactaggtaaagtcggttaggtacggtaccgtttaggttttaatttacgttagtaacctaaagtaatttaattttattaacgttacccgtttaggttaccgggttaccggtttaccggggaacccgtaaacgggggtaaccgtaaagggttgggaaacttaagtccgaaaagtaccggtaacgttggtcggtactaacccgg

SEQ ID NO: 431154 - DNA, 613 bp, Homo sapiens
  misc_feature: GZ8MTXP02JDG51.19.71.G05.1.454.CMB.2.raw
  modified_base (244)..(244): a, c, t, g, unknown or other
  modified_base (464)..(464): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgacaagtccagccaactaattcctttaanactagttaccaaacaataacgaaaactacttagcttacgtaccagacaagacgaccagaccagcctaccgtaggctgctactattacgtgggactagtcccgtaaccggggtacgtcccggggtcctacggaccgtactcgaggtcggaccgaggtccggggtctaggggacctagtacttcactctacaccgatccgagcgtacgccctagctacgggntagaagtgtgtacgtattagtttattagtagaactaaattaattattattacttacgtgtacggtaccggtacggaacggtaacgggtacgtaaggtacgtaactacgtacgaacggtaacgtacgtacggtacgacgtacgacctacg

SEQ ID NO: 431155 - DNA, 590 bp, Homo sapiens
  misc_feature: GZ8MTXP02GHGNT.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctctcgctcacctgtgccatctccggggacagagtcgctagcgacagtgttgcttggcactgggtcaggcagtccccatcgagaggtctagagtggcgtggggaagactatatttcattgtccaaacacgtaggaaataacaaaatttatagacaaccattctagttagaagtagtcgaactagaacaaatacaaacgtagaacacagtacgaaagaacctacgttacctacccgtagacagacttacgaacccttcgtcggtacgtaccgttacccggaaacggtaccgtaaccggggttacgttaaattaaacgtttaacgttagggttacgggaaacgtaaccgggacccccctaaagttaaaccgg

SEQ ID NO: 431156 - DNA, 662 bp, Homo sapiens
  misc_feature: GZ8MTXP02G5C1B.19.71.G05.1.454.CMB.2.raw
  modified_base (229)..(229): a, c, t, g, unknown or other
  modified_base (239)..(239): a, c, t, g, unknown or other
  modified_base (323)..(323): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccanaattctttanacagttaccaaacaatagaaaactacttagcttaggaccagcagacgaccaggacagccctccgtaggctagctctatttacgngggacctacgtaccgtaccccggggaagtccccggggtaccccctaggacccgtattaccgaggtcggaccaggggtccggggttacgtagggggaacctaggttactttccaaccttctacctaaccactcgaagccagccctagaccgacgggactaaggaaaggtattggtacggtacttaagttttattaagttagtaaccaaaacttaaattaactttaagttaattacgtttacggtacgggtaccggtttcggaaacccggtaaaggggtaaccgtaagggtacggtaattaacgtaacgaaggaaccgtaacgtaggtcggacctagaccg

SEQ ID NO: 431157 - DNA, 581 bp, Homo sapiens
  misc_feature: GZ8MTXP02H8A00.19.71.G05.1.454.CMB.2.raw
  modified_base (467)..(467): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgcccctcgcacgacccctctcgctccacctgtcgccagtccgtccggggacaggacgtcgctaggcgacagtgttgcttggcacgtgggtcaggccacgtccccagtccgagaggtctaggagtcgggcgtggggaaggacattattcatcgtccaagtacgtagaaatacaaattatgacacatctgttagagtagtcgtactacgaactaatacgaaacgtaacgaaacactagtaaccgaacgaacctacgttccncctacgctacgactacgacccttacgtcgtcgtaccgtaccgggaacggtaccgtacgggttattacgttaacgttacgtacgggtacggaaacgccgggtaaccccagtaacg

SEQ ID NO: 431158 - DNA, 753 bp, Homo sapiens
  misc_feature: GZ8MTXP02IBR1E.19.71.G05.1.454.CMB.2.raw
  modified_base (268)..(268): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaagccctgcacgaccctctcgctcacctgtcgccatccgtccggggacagacgtcgctagcgacngtgttgcgttggctacgtgggtcaggccacgtccccagtcgggacgtaggtcgtaaggtaggtgggacgtacgggggaaacgtactagttactttcgaacgttacggttacccaaacgtaacgggtaacggtaaaacttaaaaccgtaaaatttactacgaaccctaaaccgtacgtttacgttcggtttaggaaacgttagggttacctaacgttacgaaaccttaacgtaaacctaaaacggggttaacgaaacctaacgtaaagttaaacccggggaaaacctaacccgttaaggttacccccttacccgtaggacccgtaaacggtcccgttaccggtaaaccctttcgttaccggtacccggtaaccccggttaccgggaaacggtaccgggtaccgggggtttaactaaagtttaacggtttaccggtaggggttaaaccggaaaccgggtaccccggtaaaaccccttaagaaaccgg

SEQ ID NO: 431159 - DNA, 591 bp, Homo sapiens
  misc_feature: GZ8MTXP02H8DSU.19.71.G05.1.454.CMB.2.raw
  modified_base (237)..(237): a, c, t, g, unknown or other
  modified_base (243)..(243): a, c, t, g, unknown or other
  modified_base (325)..(325): a, c, t, g, unknown or other
  modified_base (381)..(381): a, c, t, g, unknown or other
  modified_base (415)..(415): a, c, t, g, unknown or other
  modified_base (453)..(453): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgagcgggccaccgatcaactgacaagtccagccataatnttttanacagttaccaaacaatagaaaactacttagcttacggtaccagcagagacccaggacagcctctaggctgctacatttacgngggctagtaccgtacccgggaatcccggggtacccctggaccgtatcgagtggacnggcgggtctaggggacctagtactttcacttccncacacacgagcacgctagacgagctagagtgtgtagtnttagtttatatacgtaacaattaagttaatttacttactacgttacggtacggtacgttaccggaacggtaaacgggtacgtaagggtacgtaagtaacgtaacggtaacgtaacgtacgtaggtacgtacgtacgac

SEQ ID NO: 431160 - DNA, 582 bp, Homo sapiens
  misc_feature: GZ8MTXP02IFMVQ.19.71.G05.1.454.CMB.2.raw
  modified_base (152)..(152): a, c, t, g, unknown or other
  modified_base (223)..(223): a, c, t, g, unknown or other
  modified_base (317)..(317): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccanaaggtgtcctgtcacaagtacagctgcagcagtcaggtccaggactggtagaacgccctgcacgaccctcncgctccactgtcgcctagtccgtccggggacaggacgtcgctacgcgacagtgtgcttggcacgtggtcaggcacgtcccagtcgagagtcagngtggcgtaggaacgacagttattcatcgtaccagtacgtagaaactaacgtaaatttcgagaccactatcgttagttagagtagtcgtaacgtacgaacaaacgttacgaaacgtaacgaaccaactaacgttaacgaaacggtaacctaagttccctactacgacgttaacgcgttacgaccttcgttaacgcgtacccgtaccggaaacggacgtacgggtattactagttaacgtggtacggacgtacgaccctagacgaac

SEQ ID NO: 431161 - DNA, 634 bp, Homo sapiens
  misc_feature: GZ8MTXP02G7PIT.19.71.G05.1.454.CMB.2.raw
  modified_base (324)..(324): a, c, t, g, unknown or other
  modified_base (342)..(342): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatctccggggacagacgtcgctagcgacagtgttgcttggcacgtgggtcaggcagtccccagtcgagaggtcagagtggcgtggaaggacagtatttcatgaccaanacgtggaatacgaaattntagcaccatctgttagagtagtcgactagacaactacgaaacgtacgaacaacaacgtacgaaacgaaaccctagttccctaccgtacgtacgaacgtcctacggtaaccttcgttacggtcgtaacccgttaccccggaacgggaaccgtaaccggggttagttaaacgtacgtttaacccgtaggttacgggtaaaaccggaccgggttaccccccaaagttacggaacctacgttaccggaacccgtaacccttccgtaccgttaccgtggttacgtactttaaaccgg

SEQ ID NO: 431162 - DNA, 643 bp, Homo sapiens
  misc_feature: GZ8MTXP02G7ORR.19.71.G05.1.454.CMB.2.raw
  modified_base (248)..(248): a, c, t, g, unknown or other
  modified_base (258)..(258): a, c, t, g, unknown or other
  modified_base (273)..(273): a, c, t, g, unknown or other
  modified_base (296)..(296): a, c, t, g, unknown or other
  modified_base (305)..(305): a, c, t, g, unknown or other
  modified_base (309)..(309): a, c, t, g, unknown or other
  modified_base (322)..(322): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccggcctacgactacgacgtgacaacgtcacgcataacttcttanacataccaanatacgaaaactctancttcggacagacagacacagacncgcctacgngctnctactcgttacgnggactacgtaccggtaccggtacggtccggtccctagaccgtacgtcgaggtcgcgtcggggtcgggtacgtacggactacgttacttccaccttccaccgtactagtcgacgacgtacgtccgcgacgacgacgtacgtaagtagtacggtcgttacgtttaagtttaacgtttacgttacgttaacttaaacgttaaatttaactttaagttacgttacgttacggttacggtaccggttaccggtaaccggtaaacggtaacggtacggtacgtaacgtacgtaacgtacgacgtacgtacgtacgtacgtacgtacg

SEQ ID NO: 431163 - DNA, 614 bp, Homo sapiens
  misc_feature: GZ8MTXP02G18QC.19.71.G05.1.454.CMB.2.raw
  modified_base (240)..(240): a, c, t, g, unknown or other
  modified_base (250)..(250): a, c, t, g, unknown or other
  modified_base (255)..(255): a, c, t, g, unknown or other
  modified_base (312)..(312): a, c, t, g, unknown or other
  modified_base (418)..(418): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttaanacataccaanaatanaaactatagtctgtacagcagacgacaagacacgcctcgagctgctctagtttacgnggactacgtaccgtaacccgggacgtcccgggtccccctgaccgtactcgaggtggcgcgggtccgggtcgtagggactagttacttccaccttctacgaacctancacgacgacgccgtcgacgacggacgtacgaagtagtaggtaggtagtagtttattattagtaactaaactaaattaattaattaattacgttacggttacggtacggttaccggtaaccggtaaacggtaaacggtaacggtacggtaagtaagtaacgtaacgtaacgtaacgtaggtacggtacgtacgtacg

SEQ ID NO: 431164 - DNA, 620 bp, Homo sapiens
  misc_feature: GZ8MTXP02HSRP3.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgcctacgtcgtccgggacgagagtcgctacgcgacgtagtgttgtcgtcggcgtacgtcgggtcgacggcgacgtccccacgtacggaggtaggtacgtaggtaggtggcggtagggaaggacgtattattactagtacgtacctaacgtacggtacgtaataactaatatacgacactctcgtagtagtagtagtacgtactacgacaactacgtaacgtaacgacgactacgtaacgtaacgtaacgtacgttacctacctcgtacgtacgtacgtacgtactacgtcgtacgtaccgtaccggacggtacgtacggtacgtacgttacgttacgtaggtacggacgaccgtaccgtacgtacgtacgtacgtccgtaccgtaccgtcgtcgtcgtcgtacgtacg

SEQ ID NO: 431165 - DNA, 679 bp, Homo sapiens
  misc_feature: GZ8MTXP02IM4MH.19.71.G05.1.454.CMB.2.raw
  modified_base (242)..(242): a, c, t, g, unknown or other
  modified_base (268)..(268): a, c, t, g, unknown or other
  modified_base (327)..(327): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccaggggacatcgtgatgacccagtctccagacctccctggctgtgtctcgtgggcgaggccgggccacatcaactgacaacgtccagccactaattctttanacacgttaccaataatagaaaacttntaagcttaggaccagcagacgaccagacagcctacgtaggctcgccttatactttacgngggcctaagtcccggtaaccggggagtccccggggtacctcggaccgtattccgaaggtcggacgagggtccgggggttactacggggactaagtctttacgaccttctaccacactcgaacgctaacgccctaggacgtacggacgtagaaagtagtacggtaggtaacgtttagttttaattacgggtttacaacctaaaacgttaatttaaagttttaattaacgtttaaccgttacgggtaacggttaaccgggttcccggaaaacgtaaacgggggttaaaccgaagggttacgtaaattccaaggtaaacgtaaccgtaagtcggtacggacttacgacctaaccg

SEQ ID NO: 431166 - DNA, 616 bp, Homo sapiens
  misc_feature: GZ8MTXP02H97MH.19.71.G05.1.454.CMB.2.raw
  modified_base (245)..(245): a, c, t, g, unknown or other
  modified_base (333)..(333): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgaccagtctccagacctccctggctgtgtctcgtgggcgagcggccacatcaactgacaacgtccagaccactaattcttttaanactacgttaccaaacaatagaaaacttacttagcttacggtaccagacaagacgaccaggacacgcctcgaggctgctctagtttcgnggcactaccgtaaccgggacgtcccgggtccccacgaccgtatcgaggtcgcgcggaccgggtcgtacggggactaggtactttacgacctcctacactactccacggcacgtcctgacgacggcgtagaacgattcggaggtattaggtttattagttactaacaacttaaattatttattacgttacgttacgtacgggtaccgtttacggaaccggtaaggtaccgtaaggttcgtaagtactaacggaacgtaacgtagttcggactacggtacaaccg

SEQ ID NO: 431167 - DNA, 641 bp, Homo sapiens
  misc_feature: GZ8MTXP02F2U09.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcaacaagtacagctgcagcagtcaggtccaggactggtgaacgccctcgcacgaccctctcgctcacctgtcgccagtccggtaccggggacaggacgtcgcgtagcgacgtaggttgttgcgttggcctacggtgggtacaggccacgtccccagtcggagtaggtctaggagtggacgtacggggaagtactattactttacagttacgtaccaaacgtacggtaaagtaaactaacgtaaatttcacgactaaccgtattgttagtgaagtacgtacgaactagaaactaaacgtacgaaacggtacaaccaacgtaacgttaaaccgaaaacgttaaccccgtacgtttaccctcccgtaggacaacggtcctacggtaaccttcgtacgttaccggacccgtaccgggaagtacggtaacggttataattaacgtaggaaggtacggaaccgaccgtacccaagtaaccg

SEQ ID NO: 431168 - DNA, 604 bp, Homo sapiens
  misc_feature: GZ8MTXP02JA0HI.19.71.G05.1.454.CMB.2.raw
  modified_base (239)..(239): a, c, t, g, unknown or other
  modified_base (313)..(313): a, c, t, g, unknown or other
  modified_base (321)..(321): a, c, t, g, unknown or other
  modified_base (378)..(378): a, c, t, g, unknown or other
  modified_base (410)..(410): a, c, t, g, unknown or other
  modified_base (415)..(415): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaattctttanacacgttccaaacaatagaaaactactagcttaggtaccagcaagacgaccaaggacagcctcctaggctgctntatttacngggactagtccgtacccgggaacgtcccggggtcccctgaccgattccgagtcggcngggcgggtcgtgggacagtactttcgacttcncaacntacagcacgcctgcgcgtatagaagtgtggacgttagttaagtttagtttacgtactaactaaattaatttaattactttaactacggttacggtaacgggttaccggtaaccggtaaccggtaaacggaaacggtaggtaagtaactacgaacgtaacggtaacgtacgtacggacgtcgactaaccg

SEQ ID NO: 431169 - DNA, 612 bp, Homo sapiens
  misc_feature: GZ8MTXP02H525Z.19.71.G05.1.454.CMB.2.raw
  modified_base (238)..(238): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtnccatcgtccggggacagagtcgctagcgacagtgttgcttggctacgtggtcacggccacgtccccatcggagtaggtctagaggtcggacgtcggggaaaggactaagttatttcgaagttcgtccaaacgtacggttacggaaaattaacgtaaatttatcgaacctaacagttcgtaggttacgaagtacgttaccgaatacgaaacgtatacgaaaacggttacgaaacctaactacgtaaccggaaacttaacccgtacgttacctcccgtagactaacgtcctacgtaccttcgtacgtacgaccgtacccggaagacgtacgggtattactaagttacgtaggtacggaactccggaccctaagacg

SEQ ID NO: 431170 - DNA, 594 bp, Homo sapiens
  misc_feature: GZ8MTXP02FG1Y5.19.71.G05.1.454.CMB.2.raw
  modified_base (320)..(320): a, c, t, g, unknown or other
  modified_base (413)..(413): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaacgtccagccacattctttatacagttaccaacaatgaaaactacttagcttggaccagcagaacgaccaggacacgcctaccgtaggctgctctatttacngggctactccgaaccggggacttcccggggtccccctggaccgattcaggtcgcaggcgggtctgggaccagtatttccactctacaccctancacgcacgccgtcgacgaggactaggaagtggtggtacggtattagtttagttattacgtaactaaattaattattaattacttacgttacggtacggtacggttaccggaaaccgtaaacgggtacgtaagggtacgtaatacgaacgaacgtacgtacgtcggtacgaccgtacgaccg

SEQ ID NO: 431171 - DNA, 576 bp, Homo sapiens
  misc_feature: GZ8MTXP02FTD5B.19.71.G05.1.454.CMB.2.raw
  modified_base (344)..(344): a, c, t, g, unknown or other
tcagtactctcgtgcacgaccggtgctcgatttagtgtcgtcgcaagagagagggggtaccagggcagtcaccagagctccagacaatgtctgtctccttcctctcttcctgcccgtgctgggcctcccacaaggtgtcctgtcacaagtacagctgcagcagtcaggtccaggactgtgaagcctgcagacctctcgctcacctgtgccatcctccggggacagagtcgctagcgacagtgttgcttggcactggtcaggcagtccccatcgagaggtctagagtggctgggaagcatattcatgtccacacgtggaatcaatctgccaccatctgttgacgngtcgactgaacaactacaaaccgtagaacacacgtacgaaacgaaccctaacgttcctacccgttgaccacggtctacggtaaccctctacggtcgtaccgtcccggacggacgtacggggttagtacttaacttaacgtcgtacggttaaacgaccggtacccccgtacttaacggacctacgttacggcccctaaccgttccggtctccgttcgggtactctttaaacgg

SEQ ID NO: 431172 - DNA, 652 bp, Homo sapiens
  misc_feature: GZ8MTXP02JY0SC.19.71.G05.1.454.CMB.2.raw
  modified_base (245)..(245): a, c, t, g, unknown or other
  modified_base (258)..(258): a, c, t, g, unknown or other
  modified_base (333)..(333): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccggccaccatcaactgacaagtccagccaataattctttaanacagttaccaaanaatagaaaactctagcttagaccagacaagacgaaccgaggacacgccctaccgtaggctgctactagtttacgnggacctacgtaccgtaccccggggtaactccccggggtcccccacggtacccgtattaccgaggtcggacgtagggtccggggtagtacggggaactagtactttccgacctcctaccaacccatcacgccgacgcccgtgaccgagtctaaggaaagtgtagggtcgtacgttaagtttagttagtagtaacctaaaataatttattaattaacgtacgttacgtacgggtaccggttacggaaaccggtaaacgggtaacgtaacggtagtaacttacgtaacgaacgtaaccgtacgtggtcggtactcggaaccc

SEQ ID NO: 431173 - DNA, 627 bp, Homo sapiens
  misc_feature: GZ8MTXP02JWNWF.19.71.G05.1.454.CMB.2.raw
  modified_base (251)..(251): a, c, t, g, unknown or other
  modified_base (330)..(330): a, c, t, g, unknown or other
  modified_base (338)..(338): a, c, t, g, unknown or other
  modified_base (381)..(381): a, c, t, g, unknown or other
  modified_base (430)..(430): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccgggccacatacaacgtgacaacgtccagccaactaattcttttaanactacgttacccaaataaatacgaaaactactagtcttaggaccagacaagacgaccaggacacgcctccagctagctntatttagnggcatcgtaccggatccgggcccctgacgtacttcgagtcggncggtcgggtacgtcggggactaagtcctttacgaccttcacctaaaccngtacacgctacgccgtagacgacgacgtaagtaggtgtggtacgtagtttagtttacgttagtacgttaaacgtaaattaatttaacttaactttacgttacggttacggttacggtaccggtacgggaaccggtaaaggacgttaggtaacgtactaacgtaacgaacggtaacgtgtacgtacggtactacgtac

SEQ ID NO: 431174 - DNA, 629 bp, Homo sapiens
  misc_feature: GZ8MTXP02F7S2I.19.71.G05.1.454.CMB.2.raw
  modified_base (234)..(234): a, c, t, g, unknown or other
  modified_base (241)..(241): a, c, t, g, unknown or other
  modified_base (250)..(250): a, c, t, g, unknown or other
  modified_base (254)..(254): a, c, t, g, unknown or other
  modified_base (260)..(260): a, c, t, g, unknown or other
  modified_base (271)..(271): a, c, t, g, unknown or other
  modified_base (315)..(315): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctgggctgtgtctcgtgggcgaggccgggcctacgatacgactgacaagtcagccanatcttanacatacaanatanaaactntatctagacanacagacacagacacgcctacgtagctcgtctactaagtttacgnggacctacgtaccggaacccggtacgtcccgggtaccctacgtaccgtacttcgaggtcggcgagggtccgggtaggaggtacgtacgtacttactactacctaccacactacacgacgtacgccgacgacgacgacgtacgaagtagtaggtacgtagttagttaattacgttacgtaactaacttaacttaacttaattaacttacgttacggtacggttacggtaccggtaaccggtaaacggtaacggtaacggtaacgtaacgtaacgtaacgtaacgtaacgtaacgtacggtacgtacgtacgtacg

SEQ ID NO: 431175 - DNA, 658 bp, Homo sapiens
  misc_feature: GZ8MTXP02F02VL.19.71.G05.1.454.CMB.2.raw
  modified_base (308)..(308): a, c, t, g, unknown or other
  modified_base (315)..(315): a, c, t, g, unknown or other
tcagtactctcgtgcacgaccggtgctcgatttagtgtcgtcgcaagagagaggggggcagagtctgctgaattctggctgaccagggcagtcaccagagctccagaaaatgtctgtctccttcctcttcttcctgcccgtgctgggcctcccacaaggtgtcctgtcacaagtacagctgcagcagtcaggtccaggactggtgaacgccctgcagaccctctcgctcacctgtcgccatcgtccggggacagagtcgctagcgacagtgtgcttggcacgtgggtcaggcacgtccccagtcgagngtctagngtggacgtgggaacgactattactttcatcgaccacgacgtagtaaataactaaattagtgactaacctatcttagttagagtacgttacgaacgtaggtaaactaacgttacgaaacgttaaagaacctaaacgtaaacgttaaccgaaaacgttaaacccgtaaggtttacccctacccgttacggacgtaaccgggtcttaccggtacccttacggttacggtaccggtaccccgttaccgggtaaacgggtaaccggtaccgggggttactaacgtttaaacgttaaccggtagggtaacggtaaacgggacccgtaaccccgtaagtaacggtaaccg

SEQ ID NO: 431176 - DNA, 611 bp, Homo sapiens
  misc_feature: GZ8MTXP02G4FFC.19.71.G05.1.454.CMB.2.raw
  modified_base (243)..(243): a, c, t, g, unknown or other
  modified_base (254)..(254): a, c, t, g, unknown or other
  modified_base (319)..(319): a, c, t, g, unknown or other
  modified_base (387)..(387): a, c, t, g, unknown or other
  modified_base (446)..(446): a, c, t, g, unknown or other
  modified_base (581)..(581): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactgacaagtccagccactattctttanacagttccaanaatagaaactctagcttaggaccagcagacgaccaggacagcctcgaggctgctactatttacgngggcacgtccgtaacccgggtaacgtcccggggtaccccctaggaccctattccgaaggttcggacgnggggtccgggtcgtagggaccagttactttccaactcctcaaccatcagaccacgcccngacgacgggctaggaaagtgttacggtggtacgttaaggttttattaagttcgtaacctaaattaattacttattactacgttcgggtacgtacggttacggacccgaaagggtaccgtagggtacgaattacgngaacgtaacgtacgtggtaccggtcacgtc

SEQ ID NO: 431177 - DNA, 680 bp, Homo sapiens
  misc_feature: GZ8MTXP02IP8ZU.19.71.G05.1.454.CMB.2.raw
  modified_base (251)..(251): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtggggcgagccgggccaccgatacgaactgacaacgtccagccaactaattcttttaanactacgttaccaaactaataacgtaaaacttacttagtacgttacggtaaccagacaagaacgaaccgaaggaaccacgtccctaccgtaggtctacgtactactaacgtttacgcggacctacgtaccggtaacccggggtaacggtccccggggtacccctacggtaccgtacttcgaggtcggcgcggggtcgggtacggtacgggactagtctttaccactactaccacctactcgacgccgacgtccgtacgacgacggacgtagaagtagtacggtaggtactttagttttacttagttacgtaactaaattaattaatttaattacgttacgttacggtacggtacggttacggaaccgtaaacggtacgtaacggtacgtaatacgtaacgaacgaacgtacgtcggtacgtacgtacgac

SEQ ID NO: 431178 - DNA, 590 bp, Homo sapiens
  misc_feature: GZ8MTXP02I316T.19.71.G05.1.454.CMB.2.raw
  modified_base (503)..(503): a, c, t, g, unknown or other
tcagtactctcgtggcacgaccggtgctcgatttagtgtcgtcgcaagagagagggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacagtgttgcttggcacgtggtcaggcacgtccccatcggagaggtctaggagtggcgtaggggaagacattatttcattcgtaccaaacacggtaggaaactaacaaatttagacgaccaacccgtattcgttgttacggagtacgtcgtactaggaacaaatacgaaacgtagaaacacaagtacgaaacgaacctacgttcctccctgaccagtctacgtacctcgtgtaccgaccgtccggaggacgtacgggtnttaattacgttacgtggtaggaaacgaccggaccctagtacgaacacgtacctaaccgtcgtcgtacgtggtacacttagtttacgg

SEQ ID NO: 431179 - DNA, 617 bp, Homo sapiens
  misc_feature: GZ8MTXP02JJ59T.19.71.G05.1.454.CMB.2.raw
  modified_base (307)..(307): a, c, t, g, unknown or other
  modified_base (312)..(312): a, c, t, g, unknown or other
  modified_base (335)..(335): a, c, t, g, unknown or other
  modified_base (610)..(610): a, c, t, g, unknown or other
  modified_base (613)..(613): a, c, t, g, unknown or other
  modified_base (615)..(617): a, c, t, g, unknown or other
tcagtactctcgtgcacgaccggtgctcgatttagtgtcgtcgcaagagagaggggggcacttctccctctaacactctccccagtctccagactccctggctgtgtctctgggcgagcgggccaccatcaactgcaagtccagccacaatcttttatacagttccaacaatgaaaactacttagcttggtaccagcagagaccagggcagcctcctaggctgctcatttactgggcatcgtacccgggaatcccggggtcctgaccgattcgagtggcaggcgggtctgggacagtatttcactcncaccntcagcagcctgcaggctagaagntggtagcccttaagtttattattacgtactaaaactaatttatttaattaacttaaccgtttcggtacgggttaaccggtttccgggaacccgaaagggggtaccctaaaggggttacggtaattaacgttacgaaacgaccggtaaacgttgggtacgggacttcggaacctacccgtattcgttacgtccttacacgttcccttaccccgactgtactcgaaccgtagagtacgtacgtggaccggcggtactcgggacaaggccgaatagancgncnnn

SEQ ID NO: 431180 - DNA, 640 bp, Homo sapiens
  misc_feature: GZ8MTXP02IGS0S.19.71.G05.1.454.CMB.2.raw
  modified_base (241)..(241): a, c, t, g, unknown or other
  modified_base (251)..(251): a, c, t, g, unknown or other
  modified_base (318)..(318): a, c, t, g, unknown or other
  modified_base (351)..(351): a, c, t, g, unknown or other
  modified_base (419)..(419): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccaggggacatcgtgatgacccagtctccagactccctggctgtgtctctggggcgagcgggccaccgatcaactgcaagtccagccacaattctttanacagttcaanatagaaaactcttaagcttggtaccagcagacgaccaggacagccctactaggctgactcatttcgnggcatccgtaacccgggatcccccggggtaccngacctattcgagtggcgacggtcggggtcctaggggacctagtatttcccgactctaccacctatacncgacacggtcctagccgagcgtagaaagtactggttacggacttaggttttaacttagttacgtaactaaacttaaaattattttaacgttaaacttaccgtttacggtagggtaacccgtttaccgggaaaccgtaaaacggggtacctaaaacgggtttcggaaattaacggttaccgaaaaggttaacgtaaaccgttcggtttaaggccgttaacgg

SEQ ID NO: 431181 - DNA, 687 bp, Homo sapiens
  misc_feature: GZ8MTXP02FJ5OJ.19.71.G05.1.454.CMB.2.raw
  modified_base (243)..(243): a, c, t, g, unknown or other
  modified_base (323)..(323): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccacgatacgaactgacaagtccagccataattctttanacagttaccaaacaatagaaaactcttagcttggaaccagcagagaccaggacagcctcctaggctgctctatttacggnggctacgtaccgtaccggtacgtccgggtcccctagaccgtattcgaggtcgcgtcgggcgggtacgtaggactagttacttccacctactacctacctactacgacgcccgacgtccgtacgaccgtacggagtacggaagtagtcgggttagttaacgtttaagttttaacgttacgtttacgtaacttaaaacgttaaatttaacgtttaacgtttaacgttaaccggtttaccgggtaacgggttacccggtaacccgggtaaaccggtaaaaccgggtaaaccggtaaagggttacgtaaccgttaacgtaacgtaacggtaaaccggtacgttacggtacggtacccgtacgtacccg

SEQ ID NO: 431182 - DNA, 592 bp, Homo sapiens
  misc_feature: GZ8MTXP02FWEYM.19.71.G05.1.454.CMB.2.raw
  modified_base (320)..(320): a, c, t, g, unknown or other
  modified_base (535)..(535): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccggggacagacgtcgctagcgacagtgttgcgttggctacgtgggtcaggcacgtccccagtcgagaggtctagngtggcgtagggaagacagttattcattcgtccaaacgacggtaggaaactaactaaaagttatacgactaacctattcgtgttacgaagacgttacgacttacgaacaacgtacaaacgtagaacacagtacgaaacgtaaacctacgttacctaccgtcgcgaagtcctacgtcctacgtgtaacgcccgtaccggacggaccgttacggggtnttaaacgttaacgtttacgtagggtacggaacggtacccggaccccgttaataacgg

SEQ ID NO: 431183 - DNA, 552 bp, Homo sapiens
  misc_feature: GZ8MTXP02FH2XH.19.71.G05.1.454.CMB.2.raw
  modified_base (229)..(229): a, c, t, g, unknown or other
  modified_base (236)..(236): a, c, t, g, unknown or other
  modified_base (238)..(238): a, c, t, g, unknown or other
  modified_base (242)..(242): a, c, t, g, unknown or other
  modified_base (244)..(244): a, c, t, g, unknown or other
  modified_base (246)..(246): a, c, t, g, unknown or other
  modified_base (253)..(253): a, c, t, g, unknown or other
  modified_base (259)..(259): a, c, t, g, unknown or other
  modified_base (265)..(265): a, c, t, g, unknown or other
  modified_base (280)..(280): a, c, t, g, unknown or other
  modified_base (282)..(282): a, c, t, g, unknown or other
  modified_base (284)..(284): a, c, t, g, unknown or other
  modified_base (296)..(296): a, c, t, g, unknown or other
  modified_base (332)..(332): a, c, t, g, unknown or other
  modified_base (344)..(344): a, c, t, g, unknown or other
tcagtactctcgtgcacgaccggtgctcgatttagtgtcgtcgcaagagagaggggggaggcacaacaggcaggcaggggcagcaagatggtgttgcagacccaggtcttcatttctctgttgctctggatctctggtgccacggggacatcgtgatgaccagtctccagactcctggctgtgtctctgggcgaggcgggctacggctacggacgtcactaagcagcanatcttancntcanananaactatnctgacngcaganacagacgacgctacngntnctcatacgcgcncgtacgtacgtacgtaccgtcgtcgacgtactcagngcgcgcggtcgngagtatactactactctacactactacacgacgacgtacgtacgacgacgtacgtagagtacgtacgtagtacgttacgttaagttacgttacgtactaactaacttattacgttacgttacgtacgtacgtacggtacgtaacgtaaacggtaacggtaacgtacgtacgtaacgtacgtacgtacgtacgtacgtacggacgtacg

SEQ ID NO: 431184 - DNA, 706 bp, Homo sapiens
  misc_feature: GZ8MTXP02HKRFP.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcaccctgtcgcctatccgtaccggggacagacgtcgcgtagccgacaggtgttgcgtttggcacgtggtcgaggcacgtccccagtcgagaggtactaggagtcggacgtaggggaaacggtactagttactttcaattacggtacccaaacgtaacggttaacgggtaaaacttaaaccgtaaaaagtttacgttacggaccctaaacccgtagtttaccgttacggggtttaaggtaacgggtaacggttacccggtaaacgtttacgggaaaaccgtaaaacttaaccgtaaaaccggttaacgaaacctaaacgtaacgttaaccggaaaacgtaaacccgtacgttacctacccgtcgactacggtactacgtcccttacgtacgtcgaccgtaccggaacggtaccgtacggttacgttaattaacgttacgtacggtaacggaaccggtaccgaccccgtaagtaaccg

SEQ ID NO: 431185 - DNA, 626 bp, Homo sapiens
  misc_feature: GZ8MTXP02GRZVQ.19.71.G05.1.454.CMB.2.raw
  modified_base (463)..(463): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatccgtccggggacagacgtcgctaggcgacagtgttgcgttggcacgtggtcaggcacgtcccagtcgagagtctagagtggcgtgggaagactagttattcattcgtaccaaagtacgttaggaaactaactaaaatttacacgaacctaaccctaattaccgttaggttagaaacgtacgttaccggaactagtaaaccaaatacgtaaaaccggtaanaaaccaacgtaacgtaacgaaacgtaacctaccgttccctaccgtagacgtacgtaccgtacgtaccgttcgtacgaccgtaaccgtaccggaacggtacgtacggttagttaaacgtaacgttacggtacggtaacggaacgtaccggtaccgtaagtaacg

SEQ ID NO: 431186 - DNA, 649 bp, Homo sapiens
  misc_feature: GZ8MTXP02GGB91.19.71.G05.1.454.CMB.2.raw
  modified_base (327)..(327): a, c, t, g, unknown or other
  modified_base (393)..(393): a, c, t, g, unknown or other
  modified_base (592)..(592): a, c, t, g, unknown or other
  modified_base (613)..(613): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccacgtccgtccggggacagacgtcgctagcgacaggtgttgcgttggcacgtgggtcaggcacgtccccagtcggagacggtctagnggtggcgtaggggaagtactattactttcagttcgtccaaacacggtagtaaataactaaaatttntacgaccaactagtcgtagttagaagtacgtccgaacttagaaactaaactaccgaaaaggttacaaactaacgtaacgtaaccggaaaaacggtaacccctaacggtttcccctaccccgttggaacgtaccggtacctacggtaccctttcgtacggtaccgtaacccgtacccgggagggaccgttaacggggttnttaaacgttaacgtttaccgnggttacgggaaacgtacccggtaccctaagtaacgg

SEQ ID NO: 431187 - DNA, 701 bp, Homo sapiens
  misc_feature: GZ8MTXP02IQ4B5.19.71.G05.1.454.CMB.2.raw
  modified_base (688)..(688): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctcccacaaggtgtcctgtcacaagtacagctgcagcagtcaggtccaggactggtgaacgccctcgacacgaccctctccgctcacctgtcgccctacgtccggtaccggggacacggacggttccgcgtaacggccgtacgtaggtttcggttcgtccgtttgggcctacgggtcggggtacgacgggtccctaccggttacccccgagtaccgggaggtacggttaccggtaaaggtggttacggggacgtagggggaaacgtactagtttacgtttacacgttacgtaccctaaacgtacggtaaggtaaaacttaactaaagtttactacgaccctaacctagtttccgtaggttagaacgtacgttacgaactacgaaactaactaaccgaaacgttaacaacaacgtaaacgtacgaaacgtaaccttcgttacccttaccgagacgtacgtcgtttacacccgtttgccggttaccgaccgtaaccgggacgttacgacggtttattacttaagttacgtaggtacggaaaccnccgtaccagtacg

SEQ ID NO: 431188 - DNA, 587 bp, Homo sapiens
  misc_feature: GZ8MTXP02HYYZL.19.71.G05.1.454.CMB.2.raw
  modified_base (447)..(447): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctctcgctcacctgtcgccatccgtccggggacagagtcgctagcgacagtgttgcttggctacgtgggtcaggcacgtccccagtcgagaggtcaggacgtggacgtaggggaagtacctattactttcaagttcgtaccgaacgtaacggtaggaaacttaaactaaagtttatacgacacctattactagttagagtagtacgactagacaatacaaacggtanaacaactagtacgaaacaaccctagttaccaccgtgactaacgctacgtcccttacgtcgtacgaccgtaccggaacgaccgtaacgggtattaacgtaacgttacgtaggtacggaacgaccggacccctaagtaaccg

SEQ ID NO: 431189 - DNA, 599 bp, Homo sapiens
  misc_feature: GZ8MTXP02HJBH8.19.71.G05.1.454.CMB.2.raw
  modified_base (365)..(365): a, c, t, g, unknown or other
  modified_base (510)..(510): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgaccctctcgctcacctgtcgccagtccgtccggggacaggacgtcgctagcgacgagtgttcgcgttggcacgtgggtcaggcacgtccccagtcgaagcggtctaggagtggcgtaggggaagactattatttcagtcgaccaagacgtaggaaactactaaagttnacgcaacctattcgtgttagaacgagtacgacagaactaaagtcaaacggtagacaactaagacgtaaacgaacctacgtttcccaccgtgaccgtagtctacgtaacctgtagtccgaacctcccgggaagtaccgtaacggtntaacgtacgttagtacggtaggaacgaccgtaccctaatacggactacgtcgaaccttaccgtcgtactacggtcgtacgtacttaagg

SEQ ID NO: 431190 - DNA, 641 bp, Homo sapiens
  misc_feature: GZ8MTXP02HHU1S.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccctagtccgtaccggggacacggacgtcgctacggcgaacaggttgttgcgtttggctacgtggtcacggcacgtccccagtcggagtagtcgtagaggtcggcgtaggggaacgactagttacttcgattcgtaccaaacgtacgtagaaataactaaattctacgactaacgtatcgttggtagaagtacgtacgactacgaactaagtaccgaaagtaacgaactacgtaacgtaacgaaacgaaccttacgttaccctaccgtacgacgacggtacgtacgaacccgttgtacgtacgtacccgtaaccgggtacggtaaccgtaaccgggttagttaaacttaacgttacggtaacggtaacgggtaaccgacccggtaccccgtaagtaaaccg

SEQ ID NO: 431191 - DNA, 688 bp, Homo sapiens
  misc_feature: GZ8MTXP02I291A.19.71.G05.1.454.CMB.2.raw
  modified_base (253)..(253): a, c, t, g, unknown or other
  modified_base (348)..(348): a, c, t, g, unknown or other
  modified_base (408)..(408): a, c, t, g, unknown or other
  modified_base (425)..(425): a, c, t, g, unknown or other
  modified_base (519)..(519): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggcgggccaccgactacgaactgactaacgtcacgccaactaattcttttaanactacgttaccaaacaatagaaaactacttagacttaggaaccagcaaagacgaccaggacacgcctaccgtaggctcgctacgtattttaccgngggtacctacgtcccggtaaccccggggtaagttccccggggtacccctacggaaccgtntttaccgaggtcggacncgggtcgggtaccgtggggaactaggttaactttcgaccttcacaaccctataccgagcctacggtcctggactacggggactagaaacggttnttagggacgttacgttaattttattaccgtttaagaactaaattaaattaatttaagttaacgtacgttcggtaacggtaccggttaacggaaaccggtaaaacggggtaacgtaagggtacgtaatacgtaacgaacggtaacgtaacgtcgggtacgtactaacgtc

SEQ ID NO: 431192 - DNA, 651 bp, Homo sapiens
  misc_feature: GZ8MTXP02G87EF.19.71.G05.1.454.CMB.2.raw
  modified_base (255)..(255): a, c, t, g, unknown or other
  modified_base (355)..(355): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgaggccgggccaccataccaactgacaacgtccagaccaactaattcttttaanactacgttaccaaactaataacgtaaaacttcttagcttacggaccagacaagaacgaccgaaggacacgtccctacgtaggctcgctactaatttacgnggactacgtccggtaacccgggtacgtccccggggtccacggtaccgtattcgacggtcggcacgggtcgggtcgagggactagtactttcactctacacctatcacgcacgcgtgacgaggctaagaagtcgtggtacgtactttagtttattacgtactaaactaaaattattaatttaacttacgttacggttcggacgggttaaccgttaccggaaaccggtaaacggggtaactaagggtacgtaatcgtaacgaacggtaacgtaacgtggtaacgtcactaccgtaacg

SEQ ID NO: 431193 - DNA, 546 bp, Homo sapiens
  misc_feature: GZ8MTXP02GKESY.19.71.G05.1.454.CMB.2.raw
  modified_base (241)..(241): a, c, t, g, unknown or other
  modified_base (316)..(316): a, c, t, g, unknown or other
  modified_base (349)..(349): a, c, t, g, unknown or other
  modified_base (357)..(357): a, c, t, g, unknown or other
  modified_base (383)..(383): a, c, t, g, unknown or other
  modified_base (388)..(388): a, c, t, g, unknown or other
  modified_base (433)..(433): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggccgggccaccgatcaactgcaagtccagccacaatcttttanacattccaacaatgaaaactacttagcttggtaccagcagagaccaggacagcctcctaggctgctcatttacgnggcagtccgaccggacgtccggtcccctgactntcagtgcnggcggtcgtggacagtacttcactcncacancagcacgcctgacagactagaagtgtggtacgtattagtttattntacgtaacaattaattaattattatacgttcggtacgtacgttacggaacgaaaggtaccgtaagggtacgtaatacgtaacgaacggaacgtacgtgtacgactacgtaccg

SEQ ID NO: 431194 - DNA, 613 bp, Homo sapiens
  misc_feature: GZ8MTXP02HDMSH.19.71.G05.1.454.CMB.2.raw
  modified_base (249)..(249): a, c, t, g, unknown or other
  modified_base (331)..(331): a, c, t, g, unknown or other
  modified_base (448)..(448): a, c, t, g, unknown or other
  modified_base (462)..(462): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgacggcgggccaccatcaactgacaacgtccagccaactaattcttttanactacgttaccaaacaatagaaaacttctagcttaggaccagcagacaccaggacacgcctcgtaggctgctctatttacgnggcacgtccgtaacccgggacgttcccggggacccctagaccgtattcgaggtacggcgacggggtccgggttacgtacgggggactacggttactttccgactcctacaaccctanacgacgcacgtccngacgagactaggagtgttcggtacgttacttaagtttattagtacgtaactaattaattatttattacgtacgttacggtacgtacggtacgaacgtaacggacgtaggtacgtatacgaacgtaacgacgtacgtggtacgtactacgac

SEQ ID NO: 431195 - DNA, 643 bp, Homo sapiens
  misc_feature: GZ8MTXP02ILIPS.19.71.G05.1.454.CMB.2.raw
  modified_base (452)..(452): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcgttggcacgtgggtcaggcacgtcccataccggagagtctagagtggacgtaggggaacgactattactttacacttacgtaccaaacgtacggtaggaaacttaacgtaaatttactcgactacattcgtagttcgaagagttacgaactacgaaacaaatacgaaaacgtacaanaacgtaaacgttacgaaagtaaacccgtacgttacctacccgtagtaccgaacgtaccgtacgtaacccctttcgtacgggtacctaaccggtaccccggaacgggtaaccgtaaccggggttagttaaactaacgtttaacggacggttaacgggaaaacgtacccgtaacccccgtaagttaaaaccgg

SEQ ID NO: 431196 - DNA, 657 bp, Homo sapiens
  misc_feature: GZ8MTXP02HNER9.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgcccatccgtccggggacaggagtcgctagcgacagtgtgcttggctacgtgggtcaggcacgtccccagtcgagaggtctaggagtggcgtggggaagactagttatttcagttcgtacccaaacgtaacggtaggaaacttaacgtaaaatttagtcgtacctaacctagttacgttggtttagaagtacgtacggtaactacgtaactaaacgttaccgaaaacggtaacgaactaactaagtaaccggaaacgtaaacctacggttaccctacccgtgaccgtaacggtcctacgtaacccttcgtacgtaccgtaacccgtacccggaacgggtaaccgtacggggttacgttaacttaacgttaacgtacgggtaacgggaaaccggtaccgggaccccctaaagtaaccgg

SEQ ID NO: 431197 - DNA, 695 bp, Homo sapiens
  misc_feature: GZ8MTXP02G0A4Q.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggctaggggaagactattatttcagttcgtaccaaacgtcggtaggaaacttaactaaattagtacgacctaacctaagttccgttaggtttacggaacggtacgtaccgtaacttgggaaacctaaagtaccgtaaacggtaacgaacctaacaagtaacgaaacgaaaccgttaacgttaccctacccgttagaccgtaacgtaccgttacggtaaccccttacgtcggttacgaaccccgttacccgggaacggtaaccggtaacggggttacgttaacgttaagtttaacggtagggttaacgggtaaacggaccggtaacccccgtaagtaaccggaacctacggttaccaaccccgttacctaccgttcgtcgttcggtacgtaccgtttaacgg

SEQ ID NO: 431198 - DNA, 790 bp, Homo sapiens
  misc_feature: GZ8MTXP02JUJN3.19.71.G05.1.454.CMB.2.raw
  modified_base (251)..(251): a, c, t, g, unknown or other
  modified_base (339)..(339): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccgggccaccgataccaacgtcgacaacgtccagccaactaattctttanacacgttaccaactaatagtaaaaactagtagcttaggaccagcaagacgaccgagacacgtccctcgtaggctagctatatttacgngggtacctacgtacccggtaaaccccgggtacgtccccggggttaccctacggaaccccgttagttccgacgggttcgggaccggtaacgggtcccgggggtttgacgggggtaccttaaacggttccttttacccggaacctttaccctacccaaaccggttacctacccgaacggcccgtaaccggtacccgtggaacccgttaggggaccctagggtaaaccgttagggttgggttacgttaccggtttaagtttttaaacgtttacggtttaacaaaccgttaaaactttaaatttaactttaacgttttaacgtttaccgttacgggtaacgggtttaaccggtttacccggggaacccggttaaaaggggtaacccgtaaagggggttacgtaactaacgtaccgtaaggaaccgtaagtcggttacggccttaggaccctaacg

SEQ ID NO: 431199 - DNA, 616 bp, Homo sapiens
  misc_feature: GZ8MTXP02JMT2O.19.71.G05.1.454.CMB.2.raw
  modified_base (229)..(229): a, c, t, g, unknown or other
  modified_base (338)..(338): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggctggtagaacgccctcgcacgaccctctcgctcnctgtcgccagtccggacgggacaggagtcgactaggcgacgtggttgttcgcgttcggcgtacggtgggtcgacggctaccggtcccagtcggagtacggtacgtaggngtggacggtaggggaagtactagttacttacagttaccgaccacggtacgtaagtaaacttaactaaatttagactactaacctattcgttggtaagagtcggttacacgtagaaacaagtctaaaacgtacgaccaaagacggttaacccgaagttaaaccgtcttaccctcccgtaagcccggtaatccgtaacgtccctagttaccgacgtacccgtaccgggagtaaccgtacgggtattatacgttcgaggtaacgacgtcgacctagactac

SEQ ID NO: 431200 - DNA, 554 bp, Homo sapiens
  misc_feature: GZ8MTXP02HW10Q.19.71.G05.1.454.CMB.2.raw
  modified_base (511)..(511): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcctccggggacagagtcgctagcgacagtgttgcttggcacgtgggtcaggcacgtccccagtcgagaggtctaggagtggcgtggggaaggactatatttcagttcgtccaaactacggtaggaaacttaacaaatttatcgacctaaacctatcgtagttgagtagtcgatgaactaatacaaacgtagacgactaagtacgaaacgaacctagttcctaccgtgcagctacgacctctcgtacgacctcccggagacgtacgggtntacgtaagttacgtggtacggaagtcccggaccctaagtaacg

SEQ ID NO: 431201 - DNA, 649 bp, Homo sapiens
  misc_feature: GZ8MTXP02GGZRM.19.71.G05.1.454.CMB.2.raw
  modified_base (327)..(327): a, c, t, g, unknown or other
  modified_base (387)..(387): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccaccatcaactgcaagtccagccactaattcttttatactagttacccaaacaatagaaaactacttagcttaggtaccagcagacgaccaggacagcctacgaggctgctactatttacgngggacagtccgtaacccggggagtcccggggtccccctagaccgtattcgaggtcggacngggtcgggtcgtgggacagtactttcacttcacaaccatcgagcacgcctgaccgaggctaggaaagtgtaggtggtaacttaggttttattacgttacgtaactaaaacttaatttaagtttaactttaacgttacgtttacggttacgggttaacccggtttaccgggaaccggtaaaacgggggtacccgtaaaggggttcggtaaattacgtaacgtaaacggtaaccgttaacgtcggttacggcgttacggacccg

SEQ ID NO: 431202 - DNA, 585 bp, Homo sapiens
  misc_feature: GZ8MTXP02II6SQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagacccctctcgctcacctgtcgccatcgtccggggacagagtcgctagcgacagtgtgcttggcacgtgggtcaggccacgtccccatccgagtaggtctaggaggtggcgtaggggaaggactattatttcaagttcgtaccaaacgaacggtaggaaattaaccaaaatttatacgacactattctagttagagtagtcgatacgaacaagtacaaacgtacgaacaacacgtacgaacgtaacctagttcctaccctgacacggtctacgtaccctcgtacgtcgaccgtacccggaacggaccgtaccgggttataacgtaagtttacgtaggtacgggaacggacggtacccccaagtaaccg

SEQ ID NO: 431203 - DNA, 659 bp, Homo sapiens
  misc_feature: GZ8MTXP02HS36J.19.71.G05.1.454.CMB.2.raw
  modified_base (251)..(251): a, c, t, g, unknown or other
  modified_base (263)..(263): a, c, t, g, unknown or other
  modified_base (267)..(267): a, c, t, g, unknown or other
  modified_base (273)..(273): a, c, t, g, unknown or other
  modified_base (325)..(325): a, c, t, g, unknown or other
  modified_base (369)..(369): a, c, t, g, unknown or other
  modified_base (394)..(394): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatcgacccagtcctccagacctcccgtggctgtgtctcgtgggcgagcgggcccacgatacgaactgacaacgtccagccactaattctttaanacagttaccaanatanaaactntagctagaccagcagacaccaggactagacctcaggctagctctatttacgnggactagtccgtaacccgggatcccggggtccccagtacccgtnttcgaggtcggcgaggcggggttanacggggactagttacctttcaaaccctttcaccgaccctataccaacgcgtacgcccgtcgcgacgcgtagaagtagtggtggtacgttaagttttagttaagttacgtaacgtaaactaaagtttaaactttaattaacgtttaacgtttaggttcggttacggttaccggttaccggtaaacgggaaaccggtaacgggttacggtaacgtagttaaccgaacggttaaccggaaacggtcggttacggtaccgtacgtaccg

SEQ ID NO: 431204 - DNA, 588 bp, Homo sapiens
  misc_feature: GZ8MTXP02HXHE9.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgctcacctgtcgccatccgtccggggacagagtcgctagcgacagtgttgcgtttggcacgtgggtcaggccacgtccccagtcgagaggtcgtagacgtggcgtggggaacggactagttatttcatgtccaagacgtaggaataacaattatgactacatctgtagagtagcgactagaactatacaacgtacgaacacgtactaacggaaacaacctagttacctccctacgacgacgtcgtacgtaacctcgtaggttaccgacccgtaccggaacggtaccggtaacgggttacgttaataacgtttaaccgtaggttaacgggaacggtaccggtacccccgtaagtaaacccgg

SEQ ID NO: 431205 - DNA, 671 bp, Homo sapiens
  misc_feature: GZ8MTXP02ILMUG.19.71.G05.1.454.CMB.2.raw
  modified_base (617)..(617): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtcgaagccctcgcagacccctctcgctcaccctgtcgccagtccgtccggggacagagtcgctagcgacgagtgttgcgttggcacgtgggtcaggccacgtccccagtcgaggtacggtctaaggagtgggcgtaggggaaaggactagttacgtttcaagttcgtaccgaaacacgtaggtaaactaacgtaaattatacgactaccagttctaggttagaagtacgtaccgaacgttacgaaactaaacgtaccgtaaaacgttaacgaaaccaaacgtacgttaaaccggtaaaacggaaaacccttaaccgtttcctaccccgttagaacgtacgttaaccgtctaacccgtttccgtaggtacccgtaacccggttaaaccccgggaggtaaccggtaaccggggttnttaaaccgttaagttacgtacggtacgggtaaccgaccggtaccccaataaccg

SEQ ID NO: 431206 - DNA, 583 bp, Homo sapiens
  misc_feature: GZ8MTXP02IUQJE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggacctcccacaaggtgtcctgtcacaagtacagctgcagcagtcaggtccaggactggtgaagccctcgcagacccctctcgctcacctgtcgccatccgtccggggacagagtcgctagcgacagtgttgcttggcacgtgggtcaggccacgtccccagtcgagtaggtctagagtggcgtgggaagctattatttcagttcgcctaaacgacggtaggaaattactaaattactagacacctaatctagtgaagtagtacgactagaacaatactaaagtacgaacacataccgaacgtaacctagttacctccgtagacgtacgtactacgaccttcgtacgtacgtacccgtacccggaacggtaccgtacgggttactaacgttaacgttacgtacggtacggaacgtacccggtaccccgtaagtaaccgg

SEQ ID NO: 431207 - DNA, 690 bp, Homo sapiens
  misc_feature: GZ8MTXP02F732R.19.71.G05.1.454.CMB.2.raw
  modified_base (237)..(237): a, c, t, g, unknown or other
  modified_base (320)..(320): a, c, t, g, unknown or other
  modified_base (370)..(370): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcggcacgacccctcccgctaccacctgtcgcccatccgtccgggganagagtcgctagcacagtcgtgcttggcacgtgggtcaggcagtccccatcgagaggtctagaggtggctgggaaggctaagtntttacgatcgttacccaaagaccggtaggtaaacttaaccaaaaactttnacgaccaacctatcgttggtttagaagtacggtaccgtacgttaggaaacctaagtaaccgtaaaacgttacggaaacgaaacttaagacccgtaaaagaaccccggtaatttccccgttaaccccgtacgtacgtaacgtccgttaccgtaccgtacgttacgtaccggtaacccgtaacccggacggtaacggtacgggttaacttaacgttacgtacgttacggtaacgggtaaccggacccgtaacccgtaagtaccgtactacgtccgtaccctaacggttccttacgtcgttacggtacttacggtacgtacgg

SEQ ID NO: 431208 - DNA, 611 bp, Homo sapiens
  misc_feature: GZ8MTXP02FVXZ7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtccggggacagagtcgctagcgacagtgttgcttggcacgtgggtcaggcacgtccccagtcgagaggtctagagtggcgtaggggaagactattatttcattcgtaccaacgacgtagaaataactaaatttatcgaccacctattcgtgtagagtagtccgtactacgaacaactacgaaacgtaagaacaacgtaacgtacgaaaacgtaaccgtaaccgtttccctaccccgtagaccgtagtaccgtacgtacccttacgttcggttaccgaacccgttacccgggaacggaaccgggtacgggttagttaagttaacgttacgtaggtacgggaacgaccggaccccctaagtaaccg

SEQ ID NO: 431209 - DNA, 761 bp, Homo sapiens
  misc_feature: GZ8MTXP02H6EZ0.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcggcctccacaaggtgtcctgtcacaagtacagctgcagcagtcaggtccaggactggtacgaacgccctcgacacgacccctctccgctctaccgtgtcgccctagtcccggtccggggacaggacgtcgacgtacggcgaactaggttgttcgtccgtttgggcctacggttcggggtacacgggaccctaccggttcccccgaagtaccgggaggtacggtacgtaaagggtacggttcggggtacggttaggggaaacggtaccttaagttaactttcgaaacgttaccggtaccaaacgttaacggtaacggtaaaacttaactaaaagtttacaacggaacccctaacgtattaccgttaggttaggtaacgtacgttaacgacgtaagaaacctaaagttaccgaaacggtaaccaactaaacgtaacgttaaacccgaaaacggtaaaccccgttacgttacccctacccgttaggaccttacggacttacccgtaacccgttcgtaacggtaccggtaccctaaacccgggtacgggtaaccgtaacggttgttaaacttaaccgttaacgtaggaacggaacggtacccgacccggtaaaataccgg

SEQ ID NO: 431210 - DNA, 823 bp, Homo sapiens
  misc_feature: GZ8MTXP02H40OA.19.71.G05.1.454.CMB.2.raw
  modified_base (241)..(241): a, c, t, g, unknown or other
  modified_base (320)..(320): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacatcaactgacaagtccagccactaattcttttanacagttaccaacaatagaaactattagcttggaccagcagagaccaggacagcctcctaggcctgctactagtttacgngggacataccgtaacccggggtatcccggggtaccccctggaacctattaccgaggttcgggacctagggggtccggggttacgtcgggggtaacctaacggtttacttttacccgtaaacccgtttcccgttacccgaaaccccgttaacttacccgaacggtaccccgtaaacggtcccccgttagggacccggttaacgggggacctttaaacggggaaacgttaaggttgggttaaccggggttacttttaaagggtttttaacgttttaagttttacgggttaaaacccttaaaaacgtttaaatttaaagttttttaaacctttaaacggtttttaaccggttttaacccggggtttacgggttaaccgggttttaaccccgggaaacccggttaaaagggggaacccgttaaaacgggggtacggttaaaagttaacgtaaccggtaaaggtaaaccggtaaaccggttgggtaaccgggtccttacgggaacccg

SEQ ID NO: 431211 - DNA, 715 bp, Homo sapiens
  misc_feature: GZ8MTXP02G02DR.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtccggggacaggagtcgctagcgacaggtgttgcttggcacgtgggtcaggcacgtccccagtcggaggaggtctaggagtcggcgtaggggaagactattattcgattcgtaccaaagtacggtaggaaattaacaaaatttactagacctactaagttcgtaggttgaagtacgtacgaacttaggaaacctaaagtaccgtaaaacggttaacggaaaccaacgtaaacgtaacccggaaaacgtaaacccgttacgtttaccctaccccgtacgtacgaccgtaccgttaccggtacccttacgttaccggggtaccgtaacccccggtaaacccggggtaacggggtaaacccgggtaccgggggtttaacttaaaccggtttaacgttaaacggttacgggggttaaaccgggaaaaccggttaccccgggaaaccccccgttaaaggtttaaaacccccgg

SEQ ID NO: 431212 - DNA, 559 bp, Homo sapiens
  misc_feature: GZ8MTXP02GIMKB.19.71.G05.1.454.CMB.2.raw
  modified_base (349)..(349): a, c, t, g, unknown or other
  modified_base (369)..(369): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcacgtgggtcaggcagtccccatcgagaggtctagagtggcgtaggggaagactatatttcattcgtccaanacggtagaaatacaaaattntgacactatctgttagagtagtcgactagacaactcaaacgtagaacacagtacgaaacgtaacctacgttcctacccgtgactacgccgtacgacccttgtcgtacgaccgtacccggaaagggaccgtacggggtacttaacgtaacgtttacgtaggtacggaaacgaccggacccctaagtaaccg

SEQ ID NO: 431213 - DNA, 660 bp, Homo sapiens
  misc_feature: GZ8MTXP02IT6NO.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtagaacgccctcgcacgaccctctcgctcacctgtcgccagtccgtccggggacaggacgtcgctagcgacagtgtgcgttggctacgtgggtcaggccacgtccccagtcggagtacggtctaggaggtggacgtaggggaacgactattactttcagtcgtaccacgtacggtaggaaactaactaaattacgacgaccaacctattcgtgttagagtagtacgactagaactaactacgaacgtacgaactaacgtaacgtaacggaaacgtaaccgtacgttaccctacccgtagtaccgtaacgtccgtacggtacccttacgttacggtaccggtacccgttaacccggggaacggtaaaccggttaccgggggttaatttaaacgttacgtttaacggtacggggtaaacgggaaacccggtacccggtaacccctaaggttaacgaacccg

SEQ ID NO: 431214 - DNA, 644 bp, Homo sapiens
  misc_feature: GZ8MTXP02HFK8F.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgctccacctgtcgcccagtccgtcccggggacagacgtcgctagcgactagtgttgcgtttggctacgtgggtcaggctacgtccccagtccgaggtacggtctaggaggtgggcgtaggggaaacggactattattcagtcgtaccaaacgtacggtaggaaactaactaaattatcgaccacctattcgtagttagagtacgttacaacgtagaaactaacgtacgaaacgtacgaaacctaactaagtaaccgaaacggtaaaaccctacggttacccttacccgtacgtcaacggtacctacggtacccttacgtcggtccgaaccgttaccccggggaacgtaaccggtacggggttataacgtaacgttacggtagggtacggaacggtaccggaccccgtaagtaaccgg

SEQ ID NO: 431215 - DNA, 599 bp, Homo sapiens
  misc_feature: GZ8MTXP02IFCT6.19.71.G05.1.454.CMB.2.raw
  modified_base (244)..(244): a, c, t, g, unknown or other
  modified_base (259)..(259): a, c, t, g, unknown or other
  modified_base (317)..(317): a, c, t, g, unknown or other
  modified_base (325)..(325): a, c, t, g, unknown or other
  modified_base (362)..(362): a, c, t, g, unknown or other
  modified_base (386)..(386): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacgggacatcgtgatgacccagtctccagacctcctggctgtgtctcgtggcgagccggccacatacaactgacaacgtccagaccaactaattcttttaanactacgttaccaaanaatagaaaactactagcttacggacagacagacgacaggacacgcctcgagctgcctnatttacgnggacactaccgtaccggagtccgggtccccagacctnttcgagtcggacgcggcgggtcgnggacagttctcactctacacatcacgcacgccgtgacgaggactagagtacgtggtacgtagttaagttttatagttacgtaactaaattaattactttaattatacgtttcggtacggtacgttaccggaaaccgtaaagggtaaaccgtaagggttacgtaactaacgtaacgaacggtaaacgtaacgtggtacggtactacggaacccg

SEQ ID NO: 431216 - DNA, 615 bp, Homo sapiens
  misc_feature: GZ8MTXP02HCO89.19.71.G05.1.454.CMB.2.raw
  modified_base (248)..(248): a, c, t, g, unknown or other
  modified_base (264)..(264): a, c, t, g, unknown or other
  modified_base (344)..(344): a, c, t, g, unknown or other
  modified_base (409)..(409): a, c, t, g, unknown or other
  modified_base (423)..(423): a, c, t, g, unknown or other
  modified_base (451)..(451): a, c, t, g, unknown or other
  modified_base (462)..(462): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccgggccaccatcaactgacaagtccagccaactaattcttttanacctagttacccaaanaatacgtaaaaactcttagcttaggaccagcaagacgaccaaggtaccacgcctccgtaggcctgcttactatttaccgnggactacgtaccgtaacccgggacgttcccggggtaccccctaggaccgtattcgacggtggacnggggtccggtacgngggaacagtatttccactcctacaaccntacgagcgacncgtcgcgacgactaaggagtgttaggtgtacgtttagtttagtatactaactaattaattaatttattagttacgttacggtacggtacgtacggaacgtaacggtaacgaggtacgaatacgcgaagacggtacgtagtacgtcgacgtacc

SEQ ID NO: 431217 - DNA, 654 bp, Homo sapiens
  misc_feature: GZ8MTXP02FW3RT.19.71.G05.1.454.CMB.2.raw
  modified_base (355)..(355): a, c, t, g, unknown or other
  modified_base (639)..(639): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagccgggccaccatcaactgacaagtccagccaactaattcttttaatactacgttaccaaactaaatacgaaaacttacttaagctttaggaccagacaaggaacgaacccaaggaccacgccctacccgtaggcctgtctctaagttttaaccgnggggacctagttacccggtaaccccggggtaaacgttccccgggggttacccccctaggtaaccccgtatttccgaaggttcggcgtaggggccgggtcgtaggggacctagtactttacacttctaccacctatacacgacacgccctgaccgaggactagaagtagtggtagtacgttagtttaatttagttacgtactaaataatttaaatttattattacgttcgtacggtacgttcggtaacgaaagggtacgaaggtacgataagcgaagaacgtagnggtcggcgtactacg

SEQ ID NO: 431218 - DNA, 589 bp, Homo sapiens
  misc_feature: GZ8MTXP02G7CIY.19.71.G05.1.454.CMB.2.raw
  modified_base (321)..(321): a, c, t, g, unknown or other
  modified_base (386)..(386): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtcccggggacagacgtcgctagcgacagtgttgcttggcacgtgggtcaggcacgtccccatcgagaggtctaaggngtcggcgtagggaagatatattcagttcgtccaaacgacggtagaaataactaaaagtttactanaccaacctattacgtagttagagtacgtacgaactacgaactaagtacgaaacgtaagaacacaacgtacgaaacgtaaccgtaacgttacctcccgtacgcgacgtctacgtaccttctcgtacgaccgtaccggaacggtaccgtacggttagttaacgtaacgttacgtaggtacggaacgtaccggacccctaagtacg

SEQ ID NO: 431219 - DNA, 658 bp, Homo sapiens
  misc_feature: GZ8MTXP02GHBE5.19.71.G05.1.454.CMB.2.raw
  modified_base (267)..(267): a, c, t, g, unknown or other
  modified_base (339)..(339): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatcgacccagtctccagacctcccgtggctgtgtctcgtgggcgaggccgggccaccgatacaactgacaacgtccagaccaactaattctttacactagttacccaaanaatagaaaactatagtcttaggacccagcaagacgaccaggacacgcctacaggctagcttactatttacgnggctaactccgtaacccgggagtcccggggtccccacggaccgtattccgaggtcgcgaggggtccgggtactcgggggaaactagggtacttttaccacttactaccaacccatcaaggcccaagtccccgagacgagacgtagagtgtacggtagtattagtttacttagtactaactaaattaattaagttaattacgttacgttacggtacggttaaccgttaccggaaaccggtaaacggggtaacgtaagggtacgtaacgttaacgaaccggtaaacggtaaaccgtacggtacggtacggacgtacgtacg

SEQ ID NO: 431220 - DNA, 565 bp, Homo sapiens
  misc_feature: GZ8MTXP02IJHLE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggcgtagggaaagacatatttcagtgtccaaactacgtagaatactaaattatgacacatctgtagagagtcgatgacaatacaaacgtagacacaagtacgaaacgaaccagttccgtacctgacagtcctacgtaaccctcgtcgtacgaccttacccggaaggtaccgtaaccgggttagttaattaaacgtttacgtacggttacgggaaaacggtacccggtaacccccgtaagttaaaacccgg

SEQ ID NO: 431221 - DNA, 646 bp, Homo sapiens
  misc_feature: GZ8MTXP02F1LC6.19.71.G05.1.454.CMB.2.raw
  modified_base (311)..(311): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagagtcgctaggcgacagtgttgcttggcacgtgggtcaggcacgtccccatcgagnggtctagagtggcgtaggggaagactattattacattcgtccaaacgtacggtaggtaaactaacgtaaaatttatacgaccacctaattcgttgttagaagtagtccgaagtacgaactaaatacgaaaacgtagaaacacgtaagtaacgaaaacggtaacctacgttcctacccgtagactacggcctacggtaacccttcgttacggtaccgtaaccccgttaccgggaaacgggtacccgtaaacggggttcgttaaagttaacgtttacccggtaggtttaaaccggggaaacggtaaccccggtacccccgtaaagtttaaaccccgg

SEQ ID NO: 431222 - DNA, 576 bp, Homo sapiens
  misc_feature: GZ8MTXP02IEDO2.19.71.G05.1.454.CMB.2.raw
  modified_base (235)..(235): a, c, t, g, unknown or other
  modified_base (350)..(350): a, c, t, g, unknown or other
  modified_base (381)..(381): a, c, t, g, unknown or other
tcagtactctcgtgcacgaccggtgctcgatttagtgtcgtcgcaagagagagggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgngccatcgtccggggacagagtcgctagcgacagtgttgcttggctacgtgggtcaggcagtccccatcgagagtctagagtggctaggggaagtacataatttcatcgtccaaanaacgtagaaataacaaatatcgacacaattntagtagagtagtacgactagaactaataacgaaagtacaacaacgtaataacgaaaacaacctacgttacctaccgtgacacgtcctacgtacctcgtacgtaccgtaacccgtaccggaacggtaacgtaacggttagttaaacgttaacgttaacgtacggtacggaaaacgacccggaaccccgtaagaacg

SEQ ID NO: 431223 - DNA, 565 bp, Homo sapiens
  misc_feature: GZ8MTXP02JB62V.19.71.G05.1.454.CMB.2.raw
  modified_base (286)..(286): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatccgtccggggacagagtcgctagcgacagtgttgcgttggcacgtggtcaggcacgtccccagtcgagnggtctagagtggcgtagggaagactaattactttcattcgtaccaacgacgtaggaactaacaaattatcgacacctattcgtgtagaagtagtacgactagaactaatacgaaacgtacgacacaagtacaacgaacctagttacctacctgacacgctcgaccttctacgtagtaccgtccggagtacgtacggtgtacttagttcgtagtacggaaacgccggtacccaagtacgactactcgaaccctacgtcgtactcgtcggtcacgtttacg

SEQ ID NO: 431224 - DNA, 599 bp, Homo sapiens
  misc_feature: GZ8MTXP02I9IM1.19.71.G05.1.454.CMB.2.raw
  modified_base (205)..(205): a, c, t, g, unknown or other
  modified_base (318)..(318): a, c, t, g, unknown or other
  modified_base (378)..(378): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctcgcagaccctctcgctcacctgtgccatccgtccggggacagagtcgctagcgacagtgttgcttggcacgtgggtcaggcacgtccccatcgagaggtctaaggngtggcgtacggagactattacttacacgtcgtaccaacgtacggtagtaactaataattnacaccactatcgtagtagagtacgtcgactagaactaactacgaaacgtacgaacaactaacgtaacgaaacgtaacccgtacgttcccgtaccgtagaccgtagtactacgtaccgttccgtacgtaccgtaacccgtacccggaacggtaccggtaacggttacgttaacgttaacgttacgtacggtacggaaccgtaccggtaacccgtaagtaacg

SEQ ID NO: 431225 - DNA, 588 bp, Homo sapiens
  misc_feature: GZ8MTXP02JA5AD.19.71.G05.1.454.CMB.2.raw
  modified_base (349)..(349): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagacgtcgctagcgacagtgttgcttggcacgtgggtcaggcacgtccccagtcgagaggtctaggaggtggcgtagggaagactatatttcatgaccaatacggtagaactacaattangcacatctgttgagtagtacgactagaactaatacgaaaacgtcgaacaacgtaagtaacgaaacgtaacctacgttaccctacctgacacggtctaccgtactcgtgtaccgacctccggagtacggaggttctagtatacgtaggtacgggaaagacccggtacccaaagttaccggaactaccgtaccggaacccttaccgtcgtttaccgtcggtcggttactacgtttaacggg

SEQ ID NO: 431226 - DNA, 593 bp, Homo sapiens
  misc_feature: GZ8MTXP02JSAFC.19.71.G05.1.454.CMB.2.raw
  modified_base (294)..(294): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggaccggtgaacgccctcgcacgaccctctcgctcacctgtcgccatcgtccggggacagagtcgctagcgacagtgttgcttggcacgtgggtcaggcacgtccccatcgagagtctagngtggcgtgggaagactattatttcattcgtaccaaacgacggtagaataaccctaaattatcgacactattcgtgttagagtacgttacgatcgaaactaactacaacgtagacacaataccgaaacgtacctagttccctcccgtagaccacgtctacgacccttgtcgtacgacccgtaccggaggtaccgacggttagtagttacgttacgtggtacgggaaacgtaccgggacccctaagtaacgaccagttccgacctaaccgttcgtacgtctgggtctacgttagttacggg

SEQ ID NO: 431227 - DNA, 529 bp, Homo sapiens
  misc_feature: GZ8MTXP02IF9O2.19.71.G05.1.454.CMB.2.raw
  modified_base (308)..(308): a, c, t, g, unknown or other
  modified_base (366)..(366): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtcgctagcgacagtgttgcttggcacgtgggtcaggcacgtccccagtcgagnggtctagagtggcgtgggaacgacatattcatcgtccacgcgtaggaaatacaaattnagcacctatcttagtgagagtcgactagacaatacaacgtagacaacatacgaacgacctaagttccaccgtgacacgtctcgtacctctcgtacgaccgtccgaaggaccgtacgggtagttacttagttaacgtgtacggacgaccgtacccgagtacgac

SEQ ID NO: 431228 - DNA, 659 bp, Homo sapiens
  misc_feature: GZ8MTXP02GWDOT.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccacgtcgtccggggacagacgtcgcgtacgcgacaggtgttcgcgttggcacgtgggtcaggcacgtccccatcgagaggtctagagtggcgtagggaagactagtacttaacagttcgtacccaaagacgtaggaaaacttaacgtaaaatttactacgacctaaccctaattcgttagttaggaagtacgtacgtaactagaaacaaataccgaaaacgtagaaacaactagtaacgaaacgtaaacctcgttaccctaccgtacgaccgaacgtccgtacgtaccttcgtacggtaccggtaaaccccgtaccgggaaacgggtaccggttaaccgggggttactttaaagttaaccggtttacggtacggggttaacgggaaacgggtacccccggaaccccgtaagttaaaccgg

SEQ ID NO: 431229 - DNA, 620 bp, Homo sapiens
  misc_feature: GZ8MTXP02HRRQ2.19.71.G05.1.454.CMB.2.raw
  modified_base (373)..(373): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagacgtcgctagcgacagtgttgcgttggcacgtgggtcaggcacgtccccagtcgagaggtctagaggtggcgtaggggaagactatatttcagtgtaccaaacgtacgtagaactaanaaattatcgacactatctagtgaagagtcgatagaactatacaaagtagaactacgtaatacgaaacgaacctacgttcctccgtagcgtaacgtcctacggtaacccttcgtacggttaccggtaccccgttaacccggggaacggttaaccgggtaaccggggtttagttaacgtttaaacgtttaccggtaggggtttaacggggaaacggtaaccccgggtaccccctaaaggttaaacccgg

SEQ ID NO: 431230 - DNA, 694 bp, Homo sapiens
  misc_feature: GZ8MTXP02GF3N2.19.71.G05.1.454.CMB.2.raw
  modified_base (413)..(413): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccagtccgtccggggacaggacgtcgactagcgacgtagtgttcgcgttggcacggtggtcaggcacgtcccagtcgagacggtctagagtcggacgtaggggaagtactagttactttacgacttcgtaccgaaacgtaacggtaacggtaaacttaaactaaaagtttacncggaacctaaccctaagtttccgttaggttacggaagttacgtaccgtaacgtaagtaaaccaaacgttaaccgaaacggttaaccgaaactaaccgtaacggttaaacccgaaacggtaaacccttaacgtttcccctacccgttacgaaccgttaacgtccgttacgtaaccccgttggttacggtaccgtaacccggttaaccggaacgggttaccggtacgggttacttaagttaacgttacgtagggtacgaaccgtaccggaccctaagtaaccg

SEQ ID NO: 431231 - DNA, 723 bp, Homo sapiens
  misc_feature: GZ8MTXP02IR1A7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctcccacaaggtgtcctgtcacaagtacagctgcagcagtcaggtccaggactggtgaacgccctcgcacgacccctctcgcctcacctgtcgccctacgtccgtccggggaacaggacgtccgactacggccgacgtaggttgttcgtcgtttggcctacggtgggtccacgggcctaccgtccccgattccgggagtaggtccgtaaggacggtcgggacgtaggggaaacgtactacttagtttacacgttcgtacccaaacgtacggtaaggtaaacttaaactaaaagtttacgtacgacaaacctcgtttacgtgttaggaacggtacgttaccgtaacgttacgaaaccgaagtacctaaacgggtaaactaaccaaacgttaacgttaaaccggaaacgttaaaccccgtaccggtttcccgtacccctaggtacgtacgtacccgtacgttacccttcggtacggtttcccgaacccggtacccgggtagggtacccgtaacgggtttacgttaattaacgttaaccgtaggggtaaacggaaccgacccggtacccttaagtaaccg

SEQ ID NO: 431232 - DNA, 570 bp, Homo sapiens
  misc_feature: GZ8MTXP02JQQAI.19.71.G05.1.454.CMB.2.raw
  modified_base (254)..(254): a, c, t, g, unknown or other
  modified_base (374)..(374): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgccagaccctctcgcctcacctgtcgccatcgtccgggganagagtcgctagcgacagtgttgcttggcacgtggtcaggcagtcccatcgagagtcagagtggctgggaagactagtatttcgaatcgtaccaaactacggtagaaatactaaatttacncgacacctatcgtgttgaagtagtacgactagaacatactaaacggagaacacaactacgaaacgaacctacgtttaccacctcgacacgtctacgtaacctcgtagaccgtaccgtaccggaacggtaaccgaccgggttattaactaagttaacgtaggttaacggaacgtacccggaccccctataaacccgg

SEQ ID NO: 431233 - DNA, 595 bp, Homo sapiens
  misc_feature: GZ8MTXP02FN6B2.19.71.G05.1.454.CMB.2.raw
  modified_base (328)..(328): a, c, t, g, unknown or other
  modified_base (346)..(346): a, c, t, g, unknown or other
  modified_base (482)..(482): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagagtcgctagcgacagtgttgcttggctacgtgggtcaggcagtccccagtcgagaggtcaggagtggcgtggaaggacattattcatcgaccaanacgtagaactacaaattncgacacgattcgtgttagagagtcgaactagacaaatacaaacgtagaacacaagtacgaaacgtaaacctacgtttcccaccgtgacaagccgtacgaccttcgtggtacacccgtaccggaggacgtacgggtntaagtacgttacgtggtaacggaacgacccggtaccccctaaagtacggaacacgttacccggaacccttaacccgtccggtacgtccgttggggtaccttacgtttaacggg

SEQ ID NO: 431234 - DNA, 653 bp, Homo sapiens
  misc_feature: GZ8MTXP02GIBMA.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatcgtccggggacaggagtcgctagcgacagtgttgcgttggctacgtgggtcaggcacgtccccagtcgagaggtcaggagtggacgtaggggaacgactagttatttacatcgtacccaacgtacggtaggaaacttaacgtaaaatttacgtagacccaacctaattcgttagttaggagtacgtacgtacgtacgaaactaactacgaaacgtaacgaaccaacgtaacgtaaccgaaacgtaaacccgttaacgtttcccctacccgttagacgtaacggtcctacggtacccttcgttacggtaccgtacccgttacccgggaaggaacccgttacggggttacttaacgtttaacgtttaacgtaggttaacgggaacggacccggaccccctaaagttaccgaaccg

SEQ ID NO: 431235 - DNA, 630 bp, Homo sapiens
  misc_feature: GZ8MTXP02F0I80.19.71.G05.1.454.CMB.2.raw
  modified_base (232)..(232): a, c, t, g, unknown or other
  modified_base (241)..(241): a, c, t, g, unknown or other
  modified_base (324)..(324): a, c, t, g, unknown or other
  modified_base (379)..(379): a, c, t, g, unknown or other
  modified_base (397)..(397): a, c, t, g, unknown or other
  modified_base (452)..(452): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatcaactgacaagtccagccanattctttanacagttccaactaatagaaaactcttagcttggtaaccagcaagacgaccaggacacgcctaccaggctgctactatttacgnggctagtccgtacccgggaagtccccggggtcccctgaccgtattcgagtacgcngggccggtctaggggacngttaatttccgactctacaccatcaacgtcacgcctaggacgtagactagaaagngttaggtaggtacttagtttttaattacgttacgtaactaaattaaatttactttaatttaacgtttaccgtttcggggttacggtacccggtttacggtacccggaaaagggttaccgtaaaggggttacaagttaccgaagtaacggtaacgtacgttggtaggaccttgaacccc

SEQ ID NO: 431236 - DNA, 631 bp, Homo sapiens
  misc_feature: GZ8MTXP02FNWGZ.19.71.G05.1.454.CMB.2.raw
  modified_base (287)..(287): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagagtcgctagcgacagtgttgcttggcacgtggcaggcacgtccccagtcgaggnggtactaggagtggctaggggaagacattattcattcgacctaaagacggttaggaaacttaacaaaattatcgacaacctattctagttggaagtacgtcgaatcgaaactaatacgaaacgtaagaacaacaacgtaacgaaacggaacctaacgttacctacccgtagaccaagtccttacgacccttcgtacggtacgaacccgttcccgaacgggtaccgtaacggggttagtaaatttattaacgtacggtaagggaaacggaccgggacccccaaagtaacgaaaccacgttacgaaccctaacgttaccgtcgttccgtagggtctacgtttaagg

SEQ ID NO: 431237 - DNA, 663 bp, Homo sapiens
  misc_feature: GZ8MTXP02FM023.19.71.G05.1.454.CMB.2.raw
  modified_base (235)..(235): a, c, t, g, unknown or other
  modified_base (282)..(282): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccacggggacatcgtgatgacccagtcttcagactccctggctgtgtctctgggcgagcgggccacatcaactgacaagtccagcacaatctttanacagttacaacaatgaaaactacttagcttaggaacccagccaaganacctaggacagcctcctaggctgctacatttaccgtgggactactcgtacccggggaattccggggtccccctagaccgtattccgagtggcctaggggccgggtacgtgggacctaagtactttccacctactccaaaccctggtaccagcgaacgccgtcgacgtagtacgtagtaacgtagtcggtacggtactttaagtttaacgttacgttacgtaaactaaacgttaattaacgtttaagttaacgttacgttacgggttacggtaaccgggttaccggtaaaccggtaaacggggttaaacccggtaaggttacggtaactaaccgaacggtaaacgtaaccggtacgtacggttaccggacctaccggtaccg

SEQ ID NO: 431238 - DNA, 554 bp, Homo sapiens
  misc_feature: GZ8MTXP02GE371.19.71.G05.1.454.CMB.2.raw
  modified_base (329)..(329): a, c, t, g, unknown or other
  modified_base (351)..(351): a, c, t, g, unknown or other
  modified_base (389)..(389): a, c, t, g, unknown or other
  modified_base (412)..(412): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggctacgtgggtcaggcacgtccccatcgagaggtctagagtggctaggggaagacatagtttcattcgtaccaanacggtaggaaactacaaattangacaccatcgtgtgagtagtcgatgacaatcaacgtanacacatacgaacgaacagttccnccctgacagactcgaccgtctagtcgaccgtccgagacgtacgggtatatagttacgtggtagggaacgtaccggacccctaagtacgaactacgtaccgaacccgtacctccggttctacgttcggtagtacgtttaacgg

SEQ ID NO: 431239 - DNA, 611 bp, Homo sapiens
  misc_feature: GZ8MTXP02IQDVO.19.71.G05.1.454.CMB.2.raw
  modified_base (286)..(286): a, c, t, g, unknown or other
  modified_base (361)..(361): a, c, t, g, unknown or other
  modified_base (370)..(370): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctgcagaccctctcgctcacctgtcgccatccgtccggggacagagtcgctagcgactgtgttgcttggcacgtggtcaggcacgtccccatcgagnggtctaggaggtggcgtaggggaagtacgtattactttcagtcgtaccaaacgtacggtaggaactaataaattnacgacaccntcgtagttagagtacgtcgaacgtagaactaatactaacgtaacgacaactagtacgaaacgtactaacgttcctaccgtagacgtagacctacgtaccgtacgtcgtacgtacccgtcccggaacggtacgtacgggtagttaagttaacgttacgtacgggttaacggaaacggaccggtaccccgtaagtacgaacctcgtacgaacctacccgtcgtcgtcgtaggtcgtacgttag

SEQ ID NO: 431240 - DNA, 607 bp, Homo sapiens
  misc_feature: GZ8MTXP02GO581.19.71.G05.1.454.CMB.2.raw
  modified_base (323)..(323): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaagtccagccacaattctttatacagttaccaaacaatagaaaactacttagcttaggtaccagcagacgaccaggacacgcctccgtagctgctcatttagnggctacgtccgtaacccggggagttcccggggtaccccctggaccgtattccgaggtcgacgacggtcggggtcgtggggacctagtactttcgactctcacccatcacgcacgcctagctacggcgtagaaacgagttggtaggtacttagttttaattacttacgtacaacttaacttatttaattattacgttacggttacggtaccggttaccggaccgtaaaggggaaccctaagggttaggacttacgcgtaagaacgtacgtggttacgctacgacc

SEQ ID NO: 431241 - DNA, 596 bp, Homo sapiens
  misc_feature: GZ8MTXP02ID9UP.19.71.G05.1.454.CMB.2.raw
  modified_base (249)..(249): a, c, t, g, unknown or other
  modified_base (335)..(335): a, c, t, g, unknown or other
  modified_base (362)..(362): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcactgtgccatcgtccggganagagtcgctagcgacagtgtgcttggcacgtggtcaggcacgtcccagtcgagcgtctagagtggcgtgggaacgactattacttnatcgaccagcgtaggaaatactaattngacactatcgtgtagagtacgtcgactagaactaagtaccgaacgtaacgaacaactacgtaaccgaaacgtaacccgttacgttccctaaccgtggacctaggtcctaccggtacctcgttacggtacgtcccgacccgggtaacgggaccggtacggggttacgttaagtttacgttaacggtacggttaacgggaaccgtacccggtacccccgtaagtaaccggtaaccg

SEQ ID NO: 431242 - DNA, 686 bp, Homo sapiens
  misc_feature: GZ8MTXP02I1IR1.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgcctcacctgtcgccatccgtccggggacagagtcgctagcgacagtgttgcttggcacgtggggtcaggccagtccccatcggagaggtactagaggtggcgtggggaagactatatttacacttacgtccaaacgaccggtaggtaaaactaacgaaaatttatcggaccactaactcgttaggttgaaggagttccgtaacgtgaaactaaagtaccgaaaacgttcgaaactaacctaagtaccggaaaacggtaaccctaacggtttccctcccccgttaggaccccgtaaggtccttacggtaaccccttacggttcgggttaccgtaaaccccggttaacccccggggaaggggtaacccgttaacgggggtttactttaaagtttaacgtttaaccgttagggggttaaacgggaaaacggacccggttaccccctaaaggtttaaacccgg

SEQ ID NO: 431243 - DNA, 647 bp, Homo sapiens
  misc_feature: GZ8MTXP02GVNI2.19.71.G05.1.454.CMB.2.raw
  modified_base (602)..(602): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgcccctcgcacgacccctctcgctccacctgtcgccatccgtccggggacagacgtcgacgtagcgacgagtgttcgcgttggcacgtgggtcaggccacgtccccgagtcggagtaggtctaggaggtggacgtaggggaagactagttatttcgagttcgtaccgaaagtacggtagtaaattaacctaaaatttcacgacctaaacctagttctaggtttagaacgggtacgtaccggtaattacgaaaactaacttaaccgtaaaacgggttaacgaaaccaacgtaaactaaccgggaaacgtaaaccctacggtttcctaccccgagtacccagttccgacgtaaccctcgtcggtacgacccgttacccggaaggtacgtacgggtnttacgtaagttaccgaggtacggacgacccgacccgtaagtaacg

SEQ ID NO: 431244 - DNA, 777 bp, Homo sapiens
  misc_feature: GZ8MTXP02FV67M.19.71.G05.1.454.CMB.2.raw
  modified_base (226)..(226): a, c, t, g, unknown or other
  modified_base (229)..(229): a, c, t, g, unknown or other
  modified_base (238)..(238): a, c, t, g, unknown or other
  modified_base (247)..(247): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacgatacgaactgacagtccancanaatctttanacagtcaanatagaaactactagcttagacagcagagaccaggacacgcctccgtaggcctgactctagttacgtgggactacgtcccggtaacccgggaacgttccccggggtcctacggacccgtacttcgaggtcggaccgtaggtcggggtctaggggaaccttaggtacttttacaaccttcgtaaccaccgttaaccgtacgacgtaccgtacgtcccgtacggtacggtacggtacggtaacggtaaacggttaacggttacgggttaacggttaacggtttaacgttttaaacgttttaaacgtttaaacgttaaaccgttaaaacgttaaaacgtttaaacgttttaaacgtttaaacgtttaaccggtttaccgggtttaaccgggttaaaccgggtttaaccggggttaaacccggggtaaaaccggggtaaaaccgggttaaacggggttaaacggttaaacgttaacgttaaacggtaacggtaaacggtaacggttacggtacggtaccgtacgtaccgtaaccg

SEQ ID NO: 431245 - DNA, 680 bp, Homo sapiens
  misc_feature: GZ8MTXP02JQI16.19.71.G05.1.454.CMB.2.raw
  modified_base (340)..(340): a, c, t, g, unknown or other
  modified_base (348)..(348): a, c, t, g, unknown or other
  modified_base (535)..(535): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgcctagtccgtccggggacagcgtcgctacggcgactaggtcgttcgcgtttggctacgtgggtacaggccaccgtccccagtacggagtacggtctaaggnggtcgggngtacggggaaggtacctaattactttacgagtcgtaccctaaacgtacgtaaggtaaaactaacgtaaaatttgtacgaacctaccgtaaagtttcgtagttaggaagtacgttacgacttaagaactaaacgtactaaaccgtagaaacctataaacgtacgaaaacggtaacccctagttacccnccgttagctacgtaccttacggccttcggtacgtaccgtacccggtacgggaacggtaaccgttaccgggggtaaatttaccttaaaaccggttcggtaaacggggttaacgggaaccgtaccccgggtaccttacgtaaaaccg

SEQ ID NO: 431246 - DNA, 621 bp, Homo sapiens
  misc_feature: GZ8MTXP02HIZS9.19.71.G05.1.454.CMB.2.raw
  modified_base (277)..(277): a, c, t, g, unknown or other
  modified_base (307)..(307): a, c, t, g, unknown or other
  modified_base (371)..(371): a, c, t, g, unknown or other
  modified_base (402)..(402): a, c, t, g, unknown or other
  modified_base (423)..(423): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtaccggggacaggacgtcgctacggcgactaggtgttgcgttggcacgtggtcncggcacgtccccagtcgaggtagtctaggnggtggtcggtagggaagtactagttatttcatcgtaccaacgacggtagaacctaataattacngacaccatcgtagtagagtacgtcgtactanaactaataccgtaaacggtanaactaacgtaacgtaacgaaacgtaaaccctcgttaccctacccgtcgacctacggtactaccgttaccgtcgttacggtacgaccccgtaccgggaggtaccggtaggtacttaatagttacggtaggtacggacggacccgtccctagaacgtacgctaccgccgtacgtcgtactcgtcggtactacgtttacgg

SEQ ID NO: 431247 - DNA, 593 bp, Homo sapiens
  misc_feature: GZ8MTXP02GRDTP.19.71.G05.1.454.CMB.2.raw
  modified_base (245)..(245): a, c, t, g, unknown or other
  modified_base (345)..(345): a, c, t, g, unknown or other
  modified_base (417)..(417): a, c, t, g, unknown or other
  modified_base (444)..(444): a, c, t, g, unknown or other
  modified_base (459)..(459): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcgggccacatacaactgacaagtccagccaacaattcttttaanactacgttacccaaacaatacgaaaactacttagcttaggtaacccagcaagaacgaccgaaggacaagccctccgtaggctcgacctactatttaccgngggctactaccgtacccggggaatcccggggtccaggtacccgattcgagtgcaggcgggtcagggacagtnttcactctacaccatccagcacgtccngacgagtcgagaagngtcgtagtacttagtttattagtagtaactaaattaattaattacttattacgtcgtacgtacgtacgacgaaacggacgtaaggtacgtaactacgaacgaagaacgtacgtcggtacgacgtacgactaacg

SEQ ID NO: 431248 - DNA, 755 bp, Homo sapiens
  misc_feature: GZ8MTXP02HXSN2.19.71.G05.1.454.CMB.2.raw
  modified_base (237)..(237): a, c, t, g, unknown or other
  modified_base (311)..(311): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctctgggcgagcgggccacatacaactgacaagtccagccacaatctttanacagttccaacaatacgaaactactagcttaggacagcagacgacaggacacgcctcaggctgctcatttacgngacacgtccgtaccggtacgtccggtacccctagaccgtatcgagtcggacgtcgggtcggtacgtacggactaagttctttaccgaccgtacctaccgaaacctactaccgaacgtaccgtaaccggtccgtacggacgtaaacgggtcgtaacggtaaacggtaacggttacgggttacgggttacgtttaacgttttaaacggttttaacgtttaacgttaaaccgtaaaacgttaaaacgtttaaacgttttaaacgttttaaacgtttaaccgtttaaccgggtttaaccgggtttaacccgggtttaacccgggtaaacccgggtaaaaccggggtaaaaccgggttaaaacgggttaaacggttaaacgttaaaccgtaaacgtaaacggtaaaccggttaaacggttaacggttacgggtaccgttaacggtaccg

SEQ ID NO: 431249 - DNA, 559 bp, Homo sapiens
  misc_feature: GZ8MTXP02FL3ZY.19.71.G05.1.454.CMB.2.raw
  modified_base (238)..(238): a, c, t, g, unknown or other
  modified_base (317)..(317): a, c, t, g, unknown or other
  modified_base (408)..(408): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctggcgagcgggccaccatcaactgcaagtccagccactaatcttttanacagttccaaacatgaaaactctagctggtaccagcagagaccaggtacagcctactaggctgcctacattttaccggnggtactagtccgtacccggtagtcccccggggtccagacgtatcgagtcggcacgggcggtcgtaggactagtacttcactctaccacacncacgacacgcgtgcgacgacgtagagtagtgtagtagttagtttattattagtactaactaattaattaattattacgttacgtacgtacgtacggtacgtaacggaacgtacggtagtagaagtacgacgacgacgtacgtacgacgtcg

SEQ ID NO: 431250 - DNA, 701 bp, Homo sapiens
  misc_feature: GZ8MTXP02H0ZNO.19.71.G05.1.454.CMB.2.raw
  modified_base (226)..(226): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctntccgctcacctgtcgcctactccgtaccggggacagagtcgctagcgactaggttgtcgcttggctacgtggtcaggcacgtcccagtcgagtggtacaggaggtggcgtaggggaacgtactagtactttacgagttccgtaccgaaacgtacggttaaggaaacttaaacgtaaagtttactacgaccaacgtattacgttggttacgaagtacgtaccgtacgttagaaacctaataaccgtaaaacggttacgaaacctaacgaacgttaaccgaaaacggtaaacccttacgttaccccgtaccgtacgtaccgtaacgtaccgtacgtaaccctttcggtacgggttaacccgacccgtacccggggtaacgggtaacccggtaacggggtttacgttaaacgttaacggttacgttaacgggtaaccggggaaaccgtaaccccgggtaccccctaaaaggtaacccg

SEQ ID NO: 431251 - DNA, 652 bp, Homo sapiens
  misc_feature: GZ8MTXP02H69UD.19.71.G05.1.454.CMB.2.raw
  modified_base (297)..(297): a, c, t, g, unknown or other
  modified_base (362)..(362): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgggtgaagccctcgcacgaccctctcgctcaccgtgtcgccatccgtccggggacaggacgtcgctagcgacagttgtgcttggcacgtggtcaggcacgtcccatcgagagtctaggngtggcgtagggaagactagttatttcgatcgtaccaaacgtcggtaggaaactaactaaaatttnacggacctaacgattccgttaggttagaaggtacgttacgacgtagaaccaaacttacgaaacgttacgaacaacacgttacgaaacgtaacctacgttaccctcccgtagaaaccgtcgtacctacggtaaccgttcgttacggtaccgtacccgtacccggaacggtacccgaggggttagttaacttaacgttaccgttagggaacggtaacggtacccggacccctagtaaccggactaacgtcgtaacccgtacgtccgtacgtacgtcggtacgtactttacgg

SEQ ID NO: 431252 - DNA, 660 bp, Homo sapiens
  misc_feature: GZ8MTXP02GWRV9.19.71.G05.1.454.CMB.2.raw
  modified_base (324)..(324): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccacgtcgtccggggacaggacgtcgctagcgacagtgtgcgttgctacgtggtcaggcacgtccccagtcggagaggtctaggngtgggcgtaggggagtactattattcagttcgtaccaaacgacggtaaggaaactaactaaagtttagacgacctaaactattacgtagttagaacgttacgtaccgtaacgttagaaacctaacgtaacgtaaaacggtacgaaacctaaacgtaagtaacccggtaaaagaacccgttacggtttaccctaccccgttaggacctacggtacccgttaccgtacccgtttacgtacggttaccggaaccccgttaccgggacggtaaccggtaccgggttattaacgtaacgtttacgaggtacggtaaccgtacccggtaccctagtaaaccg

SEQ ID NO: 431253 - DNA, 584 bp, Homo sapiens
  misc_feature: GZ8MTXP02HEN60.19.71.G05.1.454.CMB.2.raw
  modified_base (239)..(239): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgcaagtccagccacaatcttttanacagttccaaacaatagaaaactacttagcttagtaccagcagagaccaggacagcctcctaggctgctctatttacnggcatccgtaacccggggaatcccggggtaccccctgaccgtattcaggtggcagggtcgggtctggggacagtatttcaccttcaccaccatccagcacgcccgtgacgaggctagaagtagtaggtggtactaggtttatttagttagtacaaataattattaattaatacttacgttacggaccggtttacggacgtaaacggggaccgtaaggtacggtaattaagtcgtaagtaaccggaaactgggtacggtactaggacc

SEQ ID NO: 431254 - DNA, 585 bp, Homo sapiens
  misc_feature: GZ8MTXP02FH9G3.19.71.G05.1.454.CMB.2.raw
  modified_base (242)..(242): a, c, t, g, unknown or other
  modified_base (254)..(254): a, c, t, g, unknown or other
  modified_base (327)..(327): a, c, t, g, unknown or other
  modified_base (360)..(360): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccgatacgaactgacaagtccagcacaattctttanacagttccaaanaatgaaaactacttagacttggaccagacagacgaccaggaacagccttaccgaggctgactcttaatttcgnggctacgtccgaccggtacgtccgggtaccccnggacctattcgaggtcgacgtcgggcggtacgtagggacagttacttcacttccacaccatacgcgacctcgcgtcgacgacgtacgtagtagagtagtgtacgttagttagttattacgtaactaataattattattacgttacgttacgtacgtacgtacggacggaacggaacggtacgtacgtagtataacgacgacgtacgtagtacgtacgtacgtacg

SEQ ID NO: 431255 - DNA, 652 bp, Homo sapiens
  misc_feature: GZ8MTXP02IVH9J.19.71.G05.1.454.CMB.2.raw
  modified_base (289)..(289): a, c, t, g, unknown or other
  modified_base (301)..(301): a, c, t, g, unknown or other
  modified_base (352)..(352): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctccacctgtcgccatccgtccggggacagagtcgctagcgacagtgtgtcgttggcagtggtcaggcacgtccccagtcgagngtctagagtggngtaggaagactattattcatcgtaccaacgtaggtagaaactactaaattnacgacaccatctgtagagtagtcgatagactaagtactaaacgtacgacaacgtaagtaaccgaaacgaaaccttacgttaccctacccgtagtaaccgtacgtacgtaaccgttacccgtaacgttcgggtaaccgtaccccgtaacccggggtaacggaaaccggttacgggggttattaaccgtttaacgttaaccggtagggtaacggtaaacccggacccggtaaacccctagtaaccggactacgtcccgtaacctaccgttccgtcgttagtcggtacgtttaaccgtaaggg

SEQ ID NO: 431256 - DNA, 619 bp, Homo sapiens
  misc_feature: GZ8MTXP02HR9U1.19.71.G05.1.454.CMB.2.raw
  modified_base (156)..(156): a, c, t, g, unknown or other
  modified_base (226)..(226): a, c, t, g, unknown or other
  modified_base (255)..(255): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctcctttcctcttcttcctgcccgtgctgggcctcccanaaggtgtcctgtcacaagtacagctgcagcagtcaggtccaggactggtacgaagccctgcagacccctntcgctcacctgtcgccatcgtccgggganagacgtcgctagcgacagtcgttgcgttggctacgtgggtacacggctacgtcccctagtccggagtacggtctagagttggacgtagggaacgactagttatcgaactgtaccaaagtacgtagaaacttaacgaaatttcgacactactacttgtagttagaagtacgttacgacttaagaacaacgttacgaaaacggttacgaacctacgtaaaacttaccgaaacggtaacccttaaagttcccgttacacgacgtaacgtcgtactaaaccgtcttacggttaccgaccgttaccggtaaacgacggtaccgtagttactaacgtcgaggtacgaacggtacccaccggttaagaacg

SEQ ID NO: 431257 - DNA, 562 bp, Homo sapiens
  misc_feature: GZ8MTXP02GFI3Q.19.71.G05.1.454.CMB.2.raw
  modified_base (321)..(321): a, c, t, g, unknown or other
  modified_base (379)..(379): a, c, t, g, unknown or other
  modified_base (412)..(412): a, c, t, g, unknown or other
  modified_base (442)..(442): a, c, t, g, unknown or other
  modified_base (531)..(531): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccacaattctttatacagttaccaaacaatagaaaactacttagcttggtaccagcaagagaccaggacacgcctcctaggctgctcatttacgngggcaatccgtaaccccggggaatcccggggtccccctaggacccgattcagtcggcnggcgggtctggggaccagtattcactctcacancagcagcctgcagctagaaagatgtaggtntaagttttaatattgtaacaaataaattattaattatacgttcgtaggtacgttaggacccgaaaaggggtaccaagggtacgaattanaacgaagacgtaaacgtgtaggcctagaccg

SEQ ID NO: 431258 - DNA, 709 bp, Homo sapiens
  misc_feature: GZ8MTXP02FTCAL.19.71.G05.1.454.CMB.2.raw
  modified_base (239)..(239): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctcccacaaggtgtcctgtcacaagtacagctgcagcagtcaggtccaggacgtggtgaacgccctcgcacgacccctctcgctcacctgtcnccatccgtccggggacagagtcgctacggcgacgtagtgttgcgttggcgtacgtcgggtcaggcctacgtccccgagtccggagaggtcgtaggaggtggcgtaggggaagactattatttcattacgaccaacgacgtaggtaaactaactaaaattagtacgacctaacctagtttccgttaggttaggaagtacgtaccggacgttaagaaactaaaatccgaaaacggttaacgaacaaaccgtaagtaacccggaaaacggtaaacccttacggtttacccctacccgttaggaccaacgtaccgtacgtaaacccccttggttccggtaccggtaaccccggttacccgggtaaacggtaccggttaaaccggggttactttaaagtttaacggtttaaccggtacgggttaaccggggaaaacccgtttacccggggaaccccctaaaaggggttaaacccg

SEQ ID NO: 431259 - DNA, 677 bp, Homo sapiens
  misc_feature: GZ8MTXP02GBL6F.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtacgaacgcccctcgaccacgtacccctctcgcctcacctgtcgcccagtccgtccggggacaggacgtcgcgtacggccgacgtaggttgttcggtccgttgggcctacgtgggtcacggccacgtccccagtcggagtggtctaggaggtggcgtaggggaagtactagttatttcagttcgtaccgaaacacggtaggaaacttaacgtaaaatttcacgtacctacctattcgttagttagaagtagtaccgactacgaactaaactaccgtaaacgtaacgaacaacctaagtaaccgggaaaactaacccgttacgttaccctacccgtagacctaggtacctacggtaaccttcgtcggtaccgtacccgtacccgggaaacggtaccgttaaccggggtatttaaccggtaacgtttaaggtcgggtaaacgggtaaccgacccgggtaccccttaaggtaacccg

SEQ ID NO: 431260 - DNA, 676 bp, Homo sapiens
  misc_feature: GZ8MTXP02GJD6G.19.71.G05.1.454.CMB.2.raw
  modified_base (248)..(248): a, c, t, g, unknown or other
  modified_base (297)..(297): a, c, t, g, unknown or other
  modified_base (330)..(330): a, c, t, g, unknown or other
  modified_base (474)..(474): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccgacggggacatcgtgatgacccagtctccagactccctggctgtgtctcgtgggcgaggccgggccaccgatacgaactgacaagtccagccaacaattctttanactacgttaccaaacaatagaaaactacttagcttaggtaccagcaganaccgagacagcctcgtaggctgctcatttacgnggctactccgaacccgggagtcccggggtccccctagacccgtattccgaggtggcaggggtccgggtcgtagggggaccaggtaactttccaacctctaccaacctataccaggccacgtccgagccgaagcgtagaaacgtntggtacggtattaagttttaaagttagttaacgtaactaaacttaaatttaatttaacgttaacgtttaccggtttacgggttaacgggttacccgggtttaaccgggaaacccggtaaaacggggtaaccggtaaagggttacgtaaacgttaacgtaacggtaacggtaaaccggtaacggttggtacggcgtacgaccg

SEQ ID NO: 431261 - DNA, 738 bp, Homo sapiens
  misc_feature: GZ8MTXP02IG801.19.71.G05.1.454.CMB.2.raw
  modified_base (243)..(243): a, c, t, g, unknown or other
  modified_base (320)..(320): a, c, t, g, unknown or other
tcagtactctcgtgcacgaccggtgctcgatttagtgtcgtcgcaagagagaggggggaggtacaacagacaggcaggggcagcaagatggtgttgcagacccaggtcttcatttctctgttgctctggatctctggtgcccacggggacatcgtgatgacccagtctccagacctccctggctgtgtctcgtgggcgacgcgggccaccatcaactgcaagtccagaccataattcttttanactagttaccaaacaatagaaaactacttagcttaggaccagccaagagaaccaggacagcctaccgtaggctgctntactttacgtgggcataccgtacccggggaaactcccggggtcccccctacggtaccgtacgtttaccgaggttcggaccgtacggggccggggtttacgacgggggaaacctacggtaactttccgtaaccctcccttacaaccccttaagaccgacgccgtacgccgtacggaccgtaggacgtaaggtaaacggtagttagggtacggttaacgtttaagttttaactttaacgttacgtaaactaaacgttaaatttaaagttttaactttaacgtttacggtttaacggttaacgggttaacccgggtttaccgggaaaccggtaaaacgggtaaaccggttaaagggtaacgttaacgtaacgtaacgtaaacggtaaaccggtacggttacggtcgtaccgtacgtaaccg

SEQ ID NO: 431262 - DNA, 592 bp, Homo sapiens
  misc_feature: GZ8MTXP02IRZUO.19.71.G05.1.454.CMB.2.raw
  modified_base (241)..(241): a, c, t, g, unknown or other
  modified_base (327)..(327): a, c, t, g, unknown or other
  modified_base (361)..(361): a, c, t, g, unknown or other
  modified_base (417)..(417): a, c, t, g, unknown or other
  modified_base (424)..(424): a, c, t, g, unknown or other
  modified_base (439)..(439): a, c, t, g, unknown or other
  modified_base (444)..(444): a, c, t, g, unknown or other
  modified_base (465)..(465): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtctccagactccctggctgtgtctctgggcgaggcgggccaccatacaactgacaagtccagccaactattctttanactacgttaccaaactaatagaaaacttactagcttaggaccagacagacaccgagacacgcctcgtagctgctactattaccggnggctacgtcccgtaccggaacgtccggggtaccncggacctatccgagtcgacgaggcgggtctagggacagttacttcacctctcaacntacgacnctacgctgacgagtnagaangtgcgtatttagttattagtnaactaatattaattattacttacgttacgtaggtaaacgttccggaaacgacggtaaccgtaagggtataacgtacgttaaagaaccggtaaacgtaaggttccggtacgtaccgtacgtacctacg

SEQ ID NO: 431263 - DNA, 603 bp, Homo sapiens
  misc_feature: GZ8MTXP02GHVCB.19.71.G05.1.454.CMB.2.raw
  modified_base (527)..(527): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtacgccagtcgtccggggacagacgtcgcgtagcgacagtgtgcttggctacgtcgggtcaggcacgtccccatcgagaggtctagaggtggcgtaggggaacgactattacttcattcgtaccaacgacgtaggtaaactagtaaattagtacgacacttatcgtggtttaagacggttagaccgtacttacggaaactaaactaccgtaaaacgtacgaaaccgacgtaaacgaaccgtaacggaaccttacgttccctaacgtcggacctacgtctacgtaccccgtntacgtacgacccgttacccggagggtacccctaagggttcttaactgttacgtaggtacgacgccgacctaggaac

SEQ ID NO: 431264 - DNA, 597 bp, Homo sapiens
  misc_feature: GZ8MTXP02JQQ0Y.19.71.G05.1.454.CMB.2.raw
  modified_base (228)..(228): a, c, t, g, unknown or other
  modified_base (236)..(236): a, c, t, g, unknown or other
  modified_base (247)..(247): a, c, t, g, unknown or other
  modified_base (258)..(258): a, c, t, g, unknown or other
  modified_base (286)..(286): a, c, t, g, unknown or other
  modified_base (358)..(358): a, c, t, g, unknown or other
  modified_base (397)..(397): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanatctttanacagttccaanaatgaaaactntagcttggtaccagcagagaccaggacngcctctaggctgctcatttactggcatccgtacccgggaatccggggttccctgaccgtattcgagtcggcnggccggggtactggggacagtatttccactctcacctancagcacgcctagacgaggctagaaagtgtggtaggtacttaagtttattagttacgtaacctaaataatttaactttaattaacgttacgtttacggtacggttaaccggttaccggaaaccgtaaacggggtaaccgtaaaggggtacgtaactagtaacgtaaacggtaaccgtaacgttcggtacgaccgtacgacc

SEQ ID NO: 431265 - DNA, 628 bp, Homo sapiens
  misc_feature: GZ8MTXP02GB35N.19.71.G05.1.454.CMB.2.raw
  modified_base (389)..(389): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcagaccctctcgctcacctgtcgcctagtccgtaccggggacaggacgtcgctagcgacagtgtgcttggctacgtgggtcaggcacgtccccagtcgagtaggtctagagtggacgtaggggaacgtactattacttcagtcgtaaccacgtacgtaggtaaactaactaaattanagaccactattacgtagtagagtagtacgactaggaactaacgtacgaaacgtaagaacaacgtaacgtacgaaacgtaaacctacgttacccctaccgtacgaccgtaacgtacctacgtaacccgttcgttacggtacccgtaaacccggttccccggaaaggggtaaccgtaccggggttaataacgttaacgttaacgtaggtaacggaacgtacccggaacccagtaacgaacg

SEQ ID NO: 431266 - DNA, 600 bp, Homo sapiens
  misc_feature: GZ8MTXP02IAW7D.19.71.G05.1.454.CMB.2.raw
  modified_base (227)..(227): a, c, t, g, unknown or other
  modified_base (237)..(237): a, c, t, g, unknown or other
  modified_base (319)..(319): a, c, t, g, unknown or other
  modified_base (427)..(427): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccanattctttaanacagttccaacaatagaaaactattagacttggaccagacagacgaccaggacagccctaccgtagctagctctatttacgngggctactccgtaacccggggtaactcccggggtccctggacccgtattccgaggtcggcgagggtccgggtcgtagggactagtactttcgactctaccacatcgancagtcctagcagggctagaagtatggtagtacgttagttttattactgtaacctaaaataattattaattattacgttcgtaggttaaccggttcggaaccgtaaacgggaccgtaaaggtcggaattagtacgaacggaacgtaacgttagtacggagttacgacctaaccg

SEQ ID NO: 431267 - DNA, 632 bp, Homo sapiens
  misc_feature: GZ8MTXP02JWQVA.19.71.G05.1.454.CMB.2.raw
  modified_base (500)..(500): a, c, t, g, unknown or other
  modified_base (525)..(525): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtaccggggacaggtacgtcgcgtagaccgactaggttgttcgtcgtttggctacggtcgggtcaggtaccgtacgtccccgtagtaccggaggtacggttacgtaggaggtcggacgtaggggaacgactattacgttcgagttcgaccgtaaacgtacggttaggtaaacttaacgtaaatttagacgaccctacgtattcgttagttacggaagtacgtacgacttacgaacaatacgaaacgtgaaacanagtacgaaacgtacctacgttcccncgtagacgtacgtacgtacgtacctcgtacgtaccacccggtacgaacggaccgttacggttagtacttaagtacggtacggtacggaaccgccgtaaccgagtacg

SEQ ID NO: 431268 - DNA, 647 bp, Homo sapiens
  misc_feature: GZ8MTXP02HZT41.19.71.G05.1.454.CMB.2.raw
  modified_base (231)..(231): a, c, t, g, unknown or other
  modified_base (308)..(308): a, c, t, g, unknown or other
  modified_base (321)..(321): a, c, t, g, unknown or other
  modified_base (331)..(331): a, c, t, g, unknown or other
  modified_base (646)..(646): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcggaccaccatcaactgcaagtccagccacaatcttttatacagttccaacaatgaaaactacttagcttggtaccagcagagaccaggacagcctccaggctgctcatttacnggcatcgtacccgggaatcccggggtcctgaccgattcaggtggcagcgggtctgggacagtactttcactctcacntcagcagcctgcnggctgaagtntggtgactaagttttattagttgtacaaacttaatttatttattaattacgttcgttacggggtacgtttacggtaccgaaacggggtactaaaggggttgaacttaggtactaaaggtacggtaaacgtgggtaccgggactaggaccctaccgtaagttcttacgtttaccctttactacccgtttcccgttaccccgaccttacttaccgtacgaaaccgtacggtaaaccggtaggtttaccgtaggggacggtacccgggggtcttacggggaacgtacgggggacgaacctaaggtacgcgcgcgcgang

SEQ ID NO: 431269 - DNA, 670 bp, Homo sapiens
  misc_feature: GZ8MTXP02F94FC.19.71.G05.1.454.CMB.2.raw
  modified_base (229)..(229): a, c, t, g, unknown or other
  modified_base (284)..(284): a, c, t, g, unknown or other
  modified_base (366)..(366): a, c, t, g, unknown or other
  modified_base (413)..(413): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcagaccctctcgctcacctgtgccatccgtccgggganagagtcgctagcgacagtgttgcttggcacgtggtcaggcacgtccccatcgagnggtctagagtggcgtagggaagacagttatttcgattcgtaccaaacgtacgtaggaactaactaaattatcgactaacctntcgtgttcgaagtagtaccgactagaactaaacgtactaaacggtanaacctaacaagtaaccgaaacgtaaccctacggtttcccacccgttagactaacgtcgtaccggtacccttcgttaggtaccgtacccggttacccggaacggtacccggttaagggggtacttaacgttaaaacgttacgttacgggttaagggaaaccggtacccggtaaacccccgtaaagttaacggaacctaacggttccgaaccctaacccgtttcggtaccttccggttagggtactacgtttaaacggg

SEQ ID NO: 431270 - DNA, 727 bp, Homo sapiens
  misc_feature: GZ8MTXP02I6TW2.19.71.G05.1.454.CMB.2.raw
  modified_base (246)..(246): a, c, t, g, unknown or other
  modified_base (326)..(326): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatacaacgtgacaagtccagaccaactaattcttttaanatacgttaccaaactaatagaaaactactagtcttggaccagcagacgaccaggacagcctcaggctagctctatttacngggactacgtccgaaccccggggtaagtccccggggtaccccctaggaacccgtatttaccgaagggtcggcccaggggtccgggttccgagggggaacctagggttactttccgtaacctttacaaccctattacccaagtccgaacgtccttcgacgttacggactaggaaaagtagtgggtacgggtactttaaggtttttacttaggtttagtaaacccgttaaaagttaactttaacttttaaacggtttaatttaaaccgttttcggtaaccggttaaccggtttacgggaacccggtaaaacggggtaaaccgttaaacggggttacggtaaactttaagaacgttaaccggaaagtaaaccgttggggtacggacttacggaacccttaaccg

SEQ ID NO: 431271 - DNA, 690 bp, Homo sapiens
  misc_feature: GZ8MTXP02FTEGS.19.71.G05.1.454.CMB.2.raw
  modified_base (285)..(285): a, c, t, g, unknown or other
  modified_base (294)..(294): a, c, t, g, unknown or other
  modified_base (427)..(427): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagagtcgctagcgacagtgttgcgttggctacgtggtcaggcacgtcccagtcgagnggtctaggngtggcgtgggaagactattagtttcagttcgaccaacgtacgtaggtaactaaactaaagttatcgacaaccgtattcgtagttaggaaggtacgtaccgtaacagtaaacctaagttaaccgaaacggttanaaacctaaacgtaacgttaaacggaaaaccgtaaacccttacggtttacccctaccccgtagtaccgtaacggttacctcgggtaaccctttagtccggtacgtaacccccggttaccgggaacggtaccggttaacggggttactaacgtttacgttaaccgtgggtaacgggaaacgacccgggtacccctaaagtaccgtacgtaccgtacgtaacccctaaccgttccgtccttcggttacggtctaccgtttaaacgg

SEQ ID NO: 431272 - DNA, 615 bp, Homo sapiens
  misc_feature: GZ8MTXP02IUC5X.19.71.G05.1.454.CMB.2.raw
  modified_base (345)..(345): a, c, t, g, unknown or other
  modified_base (373)..(373): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcagtccccagtcgagaggtctagagtggcgtaggaaggacatatttcatcgtaccaacgacgtaggaactacaaattngacacctatcttgtagagtagtacgacngaacaaactactaaacgtaacgacgaacaagtacgaaacgtaaacccacgttaccctacccgtgtaccacgtcctacgtaccttcgtacgtacggtacccgtacccggaacggtaccgaccggggttagtacgttaacgtttaccgtaggtacggtaaacggaccggtacccccaagtaaccgtaaccgacgtacgtaaccctaacccgttacgtctaccgtcggttacgtaccgttaacgg

SEQ ID NO: 431273 - DNA, 579 bp, Homo sapiens
  misc_feature: GZ8MTXP02I8JKJ.19.71.G05.1.454.CMB.2.raw
  modified_base (530)..(530): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagttgttgcttggcacgtgggtcaggcacggtccccagtcgagaggtactagagtggcgtgggaagactagttatttcatcgtaccaaacgtacggtaggaaacttaactaaaatttatcgacacctattcgttgttagagtagtcgactacgaacaatacgaaacgtagaaccactacgtacgaacgaaaaccgtcgttacctaccctgacacgtcctacgtccctagtcgttacgaccgttccggaaacggtacacggggttnttaattaacgttacgttaggacgggaacgtaccggaccccaagtaaccg

SEQ ID NO: 431274 - DNA, 607 bp, Homo sapiens
  misc_feature: GZ8MTXP02J1KKS.19.71.G05.1.454.CMB.2.raw
  modified_base (250)..(250): a, c, t, g, unknown or other
  modified_base (324)..(324): a, c, t, g, unknown or other
  modified_base (333)..(333): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtcctccagacctccctggctgtgtctcgtgggcgaggccgggccaccgatacgaactgacaacgtccagccacaattcttttanactacgttaccaacaatacgaaaacttcttagcttaggaccagcagagaccaggacacgcctcgtaggctgctnactttacgnggtacatcccgtacccgggagtcccggggtccccctaggaccgtattaccgaggttcggaccgtagggtccggggttactaggggactaggtacttttcaacctcctcaccactcacgcagtcctgccaggctagaagtatggtagtattaggtttattagttctactaaataattattattactacgttcggtacggtacggttcgaacggtaaacggtaccgtaaggtacgtaatacgtaagaacgacgtacgtaggtcgtacgacgtaccg

SEQ ID NO: 431275 - DNA, 606 bp, Homo sapiens
  misc_feature: GZ8MTXP02IBI0L.19.71.G05.1.454.CMB.2.raw
  modified_base (284)..(284): a, c, t, g, unknown or other
  modified_base (327)..(327): a, c, t, g, unknown or other
  modified_base (346)..(346): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactgggtgaacgccctcgcagaccctctcgctcacctgtgccatcgtccggggacagagtcgctagcgacagtgtgcttggcactggtcaggcacgtccccatcgagnggtctaggagtggctggggaagacattattcatcgtccaaacngtagaactaacgaaatttngacaccatctgttgagtagtcgactagacaaatacgaaagtagacacaagtacggaaacaacctaagttcctccccgtgaccgaacgctacggtacccttgttacggtaccgtaccgtaccccggggaggaaccgtaaccgggggtttagtaatttaacgttaccgttagggtacgggaaacggtacccggtacccccaaagttacggacctaagtccgaaccctacgttccgtacgttcgtacggtcgtactttaacgg

SEQ ID NO: 431276 - DNA, 548 bp, Homo sapiens
  misc_feature: GZ8MTXP02F054U.19.71.G05.1.454.CMB.2.raw
  modified_base (322)..(322): a, c, t, g, unknown or other
  modified_base (377)..(377): a, c, t, g, unknown or other
  modified_base (427)..(427): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgacccctctcgctcacctgtcgccagtccgaccggggacagacgtcgctacgcgactgtgttgcttggcacgtgggtcaggcacgtcccagtcgagtagtcgtaggngtggcgtagggaacgactatattcatcgtacacgacgtaagaactaataagttancgacactattcgtgttagagagtacgactagacaatacggaactagacanacgacgaaactacctacgttacctccgagacgtactctacgactttcgacgttacaaccggtccgaacggtaggtacgtagtatattaacggaggtacggacgacccgtacagtacgtaac

SEQ ID NO: 431277 - DNA, 676 bp, Homo sapiens
  misc_feature: GZ8MTXP02FN1Z4.19.71.G05.1.454.CMB.2.raw
  modified_base (623)..(623): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccagtccgtccggggacaggacgtcgactaggcgacgtagtgttgcgttggcacgtgggtcaggccacgtccccagtcgagtaggtctagagtggcgtaggggaagactattactttcaagttcgtaccgaaacgtacggtaaggtaaacttaaactaaaagtttacgtacgaaccctaaccttaagttcgttagggtttacgaaggttacggtaccgtaacgttacggaaacctaaaactaccgtaaaacggttacgaaacctaaacgtaaacgttaaccggaaaaccggtaaacccttacgtttccctacccgttgtaccgaactcgtacggacccttaggtcgtaccgacccgtacccggaacggtaccgtaacgggttnttaaacgtaacgttacggtacggtaacggaaccgtaccgtacccgtaagtacg

SEQ ID NO: 431278 - DNA, 624 bp, Homo sapiens
  misc_feature: GZ8MTXP02I6U1G.19.71.G05.1.454.CMB.2.raw
  modified_base (240)..(240): a, c, t, g, unknown or other
  modified_base (326)..(326): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggcggccacatcaactgcaagtccagccatattctttanacacgttaccaacaatacgaaaactcttagcttacggaccagacagacgaccaggacacgcctctaggctgcttactatttacggnggactacgtaccgtacccgggaacgttcccggggtacccctcgaccgtattcgaggtcggcgcgggtcgggtcgtagggactagtctttacgaccttcacgaccataccgagcctacgcctaggccgaaggctaggaaagtcgttagggacggttactttaaggttttaacttaggttactaactaaagttatttaaactttattacgttacgttggtacggtaccgttacgggaccgtaaacggtacgtacggggtataacgtataacgaggtaacgtactggtacgacgtacaccg

SEQ ID NO: 431279 - DNA, 634 bp, Homo sapiens
  misc_feature: GZ8MTXP02I8YG6.19.71.G05.1.454.CMB.2.raw
  modified_base (581)..(581): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgtagcttggcacgtgggtcaggcacgtccccagtccggagaggtctaggtaggtggtacgtaggggaaggactagttaactttcagttcgtacccgtaaacgtacgggtaggaaacgttaacctaaaagtttatacggaaccctaacctagttcgtagttaggaacgtacgttacgactacggaactaagtctaaaacggtacgaacaacgtataacggaaacgtaacctaggttccctacccaaggcacggtactacgaccttcgtacggttacggacccttaacccgggagtaccgtaacggggttnaacttaaccgtttagcggtacggaaaacccgccggttacccaaggttaacccg

SEQ ID NO: 431280 - DNA, 697 bp, Homo sapiens
  misc_feature: GZ8MTXP02JTA6P.19.71.G05.1.454.CMB.2.raw
  modified_base (153)..(153): a, c, t, g, unknown or other
  modified_base (224)..(224): a, c, t, g, unknown or other
  modified_base (306)..(306): a, c, t, g, unknown or other
  modified_base (326)..(326): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctccanaaggtgtcctgtcacaagtacagctgcagcagtcaggtccaggactggtcgaagccctcgcaacgccctcncgcctcactgtcgcctagtccgtaccggggacaggtacgtcgacgtagccgaatggttgtgtcgttggcacgtggtcaggcncgtcccatcgagagtcgagngtggcgtacggggaagtctagttactttcgacgttcgtaccgaaacgtaccgggtaggtaaaacttaaccgtaaaagtttctacgtacctaacccgtaagtttccgtaggttaaggaagtacgttaccgaacgtaacgtaacgtaaactaccggtaaaacgtacggaaacctaacgtaagtaccgaaaaccggtaacccttacggtacccctttacccggatacccgtaacggtcccttacgtaaccccgttcgttaccggtaccggtaaccccggtaaccggttacgggtaaccgtacggtttacgttaacgttaacgttacggtaacgttacggggtaaaacggcccgttaaccccgaagttaacccgg

SEQ ID NO: 431281 - DNA, 689 bp, Homo sapiens
  misc_feature: GZ8MTXP02GGIEW.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtcgtcctgtcacaagtacagctgcagcagtcaggtccaggactggtagaacgccctcgcacgaccctctcgctcaccgtgtcgccagtccgtccggggacagacgtcgcgtacgcgaacgtgtcgttgtcgttaggctacggtgggtcacggaccacgtccccagtcggaaggtagggttacgtaggtaggtcggacggtaggggaagactagttactttcagttacgtaccaaacgtacgggttaagtaaattaacctaaaagtttacgtacgaacctacgtaacgttcgtaggttacgaaagtacgtccgtaaacgtacgaaacaaacgttaaccgaaacgttaacaaacgaactaagtaacggaaaactaaccgtaccgttacctacccgtagactaacgtccgtacgtaccccttaggtaccgttaccgacccggtaacccggaacggtaccgttaacggggtacttaacgttaacggttacggttacggaaacggggtaacctacccggaaccctaagtaaccgg

SEQ ID NO: 431282 - DNA, 711 bp, Homo sapiens
  misc_feature: GZ8MTXP02GXA1O.19.71.G05.1.454.CMB.2.raw
  modified_base (271)..(271): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtcgtccggggacagacgtcgctaggcgacngttgtgcgttggcacgtgggtcaggcacgtccccagtcggagtacggtcgtagaggtggacggtaggggaacgtactagttactttacgacttacggtacctaacggtacgggttaaacggtaaaacttaacgtaaaagtttactacggacctaaacccgtattaccgttaggttaaggaaggtaccgttacggaccgtaggtaaaactaacgtaaccgtaaacggttaacgaacctaaacgtacggtaaaccgaaacgtaaacccgttacgtttacccctacccgtaggcctaacggtccgttaacgtacccgttacggttacggttaacccgaccggttaaccccgggaagggtaaccccgttacggggttaacttaacgttacgttaacggtaggtaaccgggaaccggtacccggtacccctaagttaacgaaccg

SEQ ID NO: 431283 - DNA, 613 bp, Homo sapiens
  misc_feature: GZ8MTXP02H2SHZ.19.71.G05.1.454.CMB.2.raw
  modified_base (232)..(232): a, c, t, g, unknown or other
  modified_base (243)..(243): a, c, t, g, unknown or other
  modified_base (272)..(272): a, c, t, g, unknown or other
  modified_base (326)..(326): a, c, t, g, unknown or other
  modified_base (458)..(458): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtctccagacctccctggctgtgtctcgtgggcaggccggccaccgatcaactgacaagtccagccaanaattctttaanactagttaccaaacaatagaaaactctancttggaccagcagacgaccaggacagccctaccgtagctgactactatttacgnggctacgtaccggtaaacccgggtaccggtccccggggtacctaccggaccgtagttcgacggtcggccgtacgggtccgggtcgtagggactagttaccttcactcctaccacatacgacgccgacgtcgngacgacggtactaggaagtaggttggtcgtacgtttaagtttattacgttataaactaaattaatttaattacttaacgttacgttacgtacggtacgttacggacgtaacggacgagtacgtactagacgaagacgtagtcgacgcacgacacg

SEQ ID NO: 431284 - DNA, 766 bp, Homo sapiens
  misc_feature: GZ8MTXP02IRYD5.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcacggtccaggactggtcgaacgccctgcacgacccctctcgcctcacgtgtcgccagtccgtccggggacagacgtcgctagcgacgtagtgtcgcgttggctacgtgggtcacgggtcacgtccccagtccggagtacggtctaaggtaggtcggacggttaggggaaacgtaccttaagtttactttacgtacgttaccgtaccgtaaaccgtacgggttaaagggtaaacttaaaccgttaaaattacgtacgtacctactattcgtaggttagtacgtaacgtcgtaaacgttagaaactaaacgttaccgaaaaccggttacgaaacctaaacgtaaacgttaacccgggtaaaacgtaaaacccccgtcggtttaacccctaccccggttaggacgttaaaccgccggttaaacctacccgttcgtacggggttacccgtacccggttaaccccggggaacgggtaacccgggttaaaaccggggtttacgtttaaacgtttaaccggttaaacgggtaacggggtaaaacgggtaacccggtaaccccggtaaccccgtaaaggtaacccg

SEQ ID NO: 431285 - DNA, 638 bp, Homo sapiens
  misc_feature: GZ8MTXP02I4OHN.19.71.G05.1.454.CMB.2.raw
  modified_base (260)..(260): a, c, t, g, unknown or other
  modified_base (332)..(332): a, c, t, g, unknown or other
  modified_base (397)..(397): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggcgggccaccatcaactgacaagtccagccaactaattcttttaactagttacccaaanaatagtaaaactacttagcttggtaaccagacagagacctaggacagcctcctaggctgctctagtttacgnggctactccgtaaccccgggaagttccccggggtccccctaggacccgtattccgaggtcggacngggccgggttcgaggggaccagtactttcactcctcacccatccgaggcctacgcccgtgaccgaggctagaaagtgttaggtcgggtattaaggttttattagttcgaacctaaataatttaagttatttaagtaccgtttgaacggttaccgttacggaccgtaaacggggaactaaagggttcgaaaggtttactaacgaaaggtacccgtaaacggttgtacggtaccgtacgtacc

SEQ ID NO: 431286 - DNA, 683 bp, Homo sapiens
  misc_feature: GZ8MTXP02GOFN8.19.71.G05.1.454.CMB.2.raw
  modified_base (242)..(242): a, c, t, g, unknown or other
  modified_base (256)..(256): a, c, t, g, unknown or other
  modified_base (317)..(317): a, c, t, g, unknown or other
  modified_base (328)..(328): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccaggggacatcgtgatgacccagtctccagactccctggctgtgtctcgtgggcgaggccggccaccatcaactgacaacgtccagccaactaattcttttanactacgttaccaanaatagaaaacttacttagcttagtaaccagacaagacgacaggacacgcctcgagctgctntacgtttacgngggacctagttacccgtaacccggggacgtccccggggtcctacgaccgtattcgaggttacggcgacgggtcggggtactacggggactagtactttcgaccttcgtacccaactactcgaacggtccacgtcccgtagacctaaagggtcctaggaaagtcgttggtaccggtactttaaggtttacttagtactaaacctaaattaagtttaactttattaacgttaccggttcgtacggggttaaccgttaccggaaacgaaacggggttaccgaaagggttacgaatttaaccgaagtaacggtaaaccggttacgttagggtaccgtacgtaaccggacctttaaaccg

SEQ ID NO: 431287 - DNA, 632 bp, Homo sapiens
  misc_feature: GZ8MTXP02IXO34.19.71.G05.1.454.CMB.2.raw
  modified_base (584)..(584): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatccgtccggggacagacgtcgctagcgacagtgttgcgttggcacgtggtcaggccacgtccccagtcggagacggtctaggagtggacgtaggggaagactattagtttacagttacgtacccgaaacgtacggtaggtaaaattaacgtaaaatttagcgaaccaacctaattcgtaggttagaagtacgttaccgaacgtacgaaactaaacttacgaaaacggtaacgaaaccaacgtaacgtaaccgaaaagtaaacccttacgttccctaccgcgaaccagtcctacgaaccttcgtcgtaaccggtaccgaccggtaacggaccgtaacggggttntaaacgttaacgttaacgtggtacggaacgtaccggacccagtaaacg

SEQ ID NO: 431288 - DNA, 597 bp, Homo sapiens
  misc_feature: GZ8MTXP02IU6ZI.19.71.G05.1.454.CMB.2.raw
  modified_base (237)..(237): a, c, t, g, unknown or other
  modified_base (327)..(327): a, c, t, g, unknown or other
  modified_base (568)..(568): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctccacctgcnccagtcgtccggggacagacgtcgctagcgactgtgtgcgttggctacgtgggtcaggccacgtcccagtcgagacggtcaggtagtggngtagggaaccgactagttacttcattccgtaaccacgtacggtaggaaacttaaactaaagttataggacccaacgtattcgttagttaggacgtagtactacgttacaacgtaaataccgaaacgttacgaaaccacgtaagtacgaaaacgtaccttaacgttcctcccgtagtcaacggtcttacgacttcgtacgtcgacctaccggagtacgtacgggttattacgtagttaacgnggtaaacgacggtccgaccctagactacg

SEQ ID NO: 431289 - DNA, 621 bp, Homo sapiens
  misc_feature: GZ8MTXP02ION1V.19.71.G05.1.454.CMB.2.raw
  modified_base (357)..(357): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcacgtccccatcgagaggtctagagtggcgtaggggaaggactattatttacattcggtaccaaagacgtaggaaactaacaaaatttancgacaacctatcgttagttgagtagtccgacgtagaacgaaactacaaacgtagaacacacgtacgtaaacgaaacctacggttcctacccgtacgacgtacgtacctacggtaccttcgttacggtcgaaccgttaccccggagggaaccgtacgggttagttacgtaagttaaccgttggtacggtaaacgaccggtacccccaaagtacgacaacgtccgaaccctaccgttaccgtcgtacgtcggttcgtacgttaacg

SEQ ID NO: 431290 - DNA, 657 bp, Homo sapiens
  misc_feature: GZ8MTXP02JK5Q6.19.71.G05.1.454.CMB.2.raw
  modified_base (310)..(310): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaacgccctgcacgaccctctcgctcacctgtcgccatccgtccggggacagacgtcgctagcgacgagtgttgcgttggcacgtgggtcaggcacgtccccagtcgagnggtactaggaggtgcggtagggaacgtacattattacgattacggtaccacgtacgggtaggtaaaacttaacctaaaagtttactacgtaccctaacctatttaccgttaggttaggtaacggtacgttacgtaacgttacggaaacctaaaagttaccgaaaacgttacggaaaccgtaaacacgttaaacgaaacggtaaccgtaaacgttacccgtacccgttacgaccgtacgaccgttacgtacccttacggttacgtacgcccggtacccggaggtaccgtacggggttatacgttaacgtaagtacggtacggaacgtacgacccctaagtactaaccg

SEQ ID NO: 431291 - DNA, 665 bp, Homo sapiens
  misc_feature: GZ8MTXP02GR6NF.19.71.G05.1.454.CMB.2.raw
  modified_base (328)..(328): a, c, t, g, unknown or other
  modified_base (519)..(519): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcgaactgacaagtccagccactaattctttagactagttaccaaactaatagaaaactacttaagcttaggtaccagacaagagaccaggacacgcctccaggctgctatactttacgngggactacgtaccgtaaccccggggtaagttccccggggtaccccctaggtaacccgtagttacgaacgggttcggaccgacggggtccggggttacggacggggtaaccgaagttaccgtttcaaaccttcccgtactaaccccaagtaccaacgaccgacgtcccgtagaccgacgtactaggaaagtntaggtcgtaagttagttttaacgttagtataacctaaataatttaattagtttaactaacgttcgtaggtaccgttacggaccgtaaacggacgtaacgtacggaattactaacgaagtaaccgtacgtggtacgcgttacgaacc

SEQ ID NO: 431292 - DNA, 630 bp, Homo sapiens
  misc_feature: GZ8MTXP02H2JSR.19.71.G05.1.454.CMB.2.raw
  modified_base (246)..(246): a, c, t, g, unknown or other
  modified_base (260)..(260): a, c, t, g, unknown or other
  modified_base (272)..(272): a, c, t, g, unknown or other
  modified_base (298)..(298): a, c, t, g, unknown or other
  modified_base (311)..(311): a, c, t, g, unknown or other
  modified_base (325)..(325): a, c, t, g, unknown or other
  modified_base (383)..(383): a, c, t, g, unknown or other
  modified_base (394)..(394): a, c, t, g, unknown or other
  modified_base (458)..(458): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgaggggacatcgtgatcgacccagtctccagacctccctggctgtgtctcgtgggcgaggccgggccacatcaactgacaagtccagccaactaattcttttanactagttaccaaanaataagaaactntagcttggaccagcagacacaggacncgcctacgaggcngcttacatttacgnggactagtaccgtaccgggtaatcccggggtcccctagaccctattcgagttcggacngggtccgggtntacgggggactagttacgtcaacccgtctaccgaacctactcgaaggtccacgccctgaaccgngtcagagtacgtggtacggtactaaagttttattagttagtaacctaaattaaagtattttaactaacgttacgtttcggacggttacgtttcccgggaaacgtaaacggggtaacgtacggtacggtaattacgtaacgaacgtaaacgtacggtgtacggacttacgacg

SEQ ID NO: 431293 - DNA, 750 bp, Homo sapiens
  misc_feature: GZ8MTXP02GL5H3.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcagtccccagtcgagaggtctagagtgcgtgggaagacatatttcattcgtaccaacgtaacggtggaaactaacgaaattatacggacaaccctaattcgttaggttagaaggtaacggttccgtaacgtagggtaaacctaaacgttaaccgtaaaaccggttaacggaaaccaaccctaaagttaaccggaaaaccggtaaaacccctaacgggttttacccctacccccttaggacccgtaagtcccgttacggaaccccgtttcttacgggtaccgtaccccgttacccccgggaacgggtaacccgtacggggttacgttaacgttacgtttaacggttacggggttaacgggaaaacggtaaccccggggtacccccctaaaggttaaccgaaccgtaacgttaccggtaacccctaacccgtttacccggttcccgtttacccggtaggtttaccggtacgttttaaacccgggg

SEQ ID NO: 431294 - DNA, 647 bp, Homo sapiens
  misc_feature: GZ8MTXP02HN14Z.19.71.G05.1.454.CMB.2.raw
  modified_base (222)..(222): a, c, t, g, unknown or other
  modified_base (455)..(455): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttctcctgccgtgctgggcctccacaaggtgtcctgtcacaagtacagctgcagcagtcaggtccaggactggtgacgccctcgcacgaccctcncgctcacctgtcgcctatccgtccggggacagacgtcgcgtagcgacagtgttgcgtttggctacgtggtcacggcacgtccccagtccggagtcggtctaggagtggcgtaggggaagactagttactttcagttcgtaccaaactagtagtaaataactaaattactacggacctactatcgttaggtacgaagtacgtccgaagttagaactaaagtcgaaacggttaanaccaactaacgtacgaaaacgtaaccctacggttacctacccgtagactacggtacctacgtaaccccttagccggtttacgaccccgttaacccgggaaacgggtaccgtaaccgggggtttattaacgttaacggtttaccgtagggttaaaccgggaacggtacccgggtacccctaaagttaacccgg

SEQ ID NO: 431295 - DNA, 532 bp, Homo sapiens
  misc_feature: GZ8MTXP02HN9UV.19.71.G05.1.454.CMB.2.raw
  modified_base (373)..(373): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctacgcaagacccctctcgctcacctgtgccatcctccggggacagagtcgctagcgacagtgttgcttggcacgtgggtcaggcagtccccatcgagaggtctagagtggctggggaagacgatatttcattgtccaaacacgtggaaataacaaatttangactacatctgttagagagtacgactgacaatcgaaacgtagacaactatacgaaacgaaccacgttctacccgtgacagctagacccttgtcgtcgactcccgagaccgtacgggtactagttaagtacgtggtacggaacgtccggaccccataacg

SEQ ID NO: 431296 - DNA, 708 bp, Homo sapiens
  misc_feature: GZ8MTXP02FRPV5.19.71.G05.1.454.CMB.2.raw
  modified_base (226)..(226): a, c, t, g, unknown or other
  modified_base (239)..(239): a, c, t, g, unknown or other
  modified_base (264)..(264): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctcncgctcacctgtcnccatccgtccggggacaggagtcgngtacgcgacgagtgttgcttcgggcacgttgggtcaggcctacgtcccccagtacggagagggtcgtaggaggtcggtcgtaggggaacggtacctagttactttcgatcggtccaaacgacggttaggtaaacttacgtaaaaatttcgtacggtaccctaaacccgtaaagtttccgttagggtttacggtaaggttaacggtaccggtaaacctttacgggaaacctaaaacgttaccgtaaaaaccgggttacgaaaaccaacgtaaccgttaaacggaaaacccgttaaacccgtaaacggtttccctaccccggttaggacctaacggtcctacgtaacccggttctacgtacgtacccgtacccgggtaagaccggttacggtagttaacttaagttaccgtaggtacggtaacggaccgtaccccgaagttaaccg

SEQ ID NO: 431297 - DNA, 656 bp, Homo sapiens
  misc_feature: GZ8MTXP02GHT3X.19.71.G05.1.454.CMB.2.raw
  modified_base (254)..(254): a, c, t, g, unknown or other
  modified_base (267)..(267): a, c, t, g, unknown or other
  modified_base (339)..(339): a, c, t, g, unknown or other
  modified_base (621)..(621): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggcttgtgtctcgtgggcgaggccgggccaccgatacaactgacaagtccagaccaactaattccttttaanacagttaccaaanaatagaaaactacttagcttagaccagcaagacgaccaggacacgcctacgtaggctgcctatactttacgnggtcctacgtaccgtaacccggggacgttcccggggtaccccctaggacccgtattcccgaggttcgggacgtacggggtccgggtacgttacgggggaactacggttaactttccgaaaccttcctaccaaacctacgtaccagcgaccgcccgtagacgtacggacgtaagaaagtagtcggtaggttatttaaggtttattatactaataaattaatttaattattagttaccgttgtacggtacgttcggacgaaaacggtactagggtacaagttanaaccggaagtaacgtacgtggtcgtcgtacgtacc

SEQ ID NO: 431298 - DNA, 712 bp, Homo sapiens
  misc_feature: GZ8MTXP02GCXBT.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatccgtccggggacaggacgtccgctaggcgacgtagttgttcgcgttggctacggtgggtcaggccacgtccccagtcggagaggtctaggtagtggacgtaggggaacgactagttacttcgagttcgtacctaaacgtacggttaaggtaaacttaaccgtaaaatttacgtacgacctaacctaagttccgttaggttacggaagttacggtaccgtaaacgtacggaaacctaaaacgttaccgtaaaaaccggttacgaaaccctaacgtaaacgtaaccgggtaaaaccgtaaacccttaacggtttccctaccccgttaggaaccgtaacgtccgttacggtaaaccccttggtacggtaccgtaccggtaaacccgggaaggtaccgtaaccggggttattaaacgttaacgttaacggtacggtaacgggaacgtaccccggtaccctaaggtaaacccg

SEQ ID NO: 431299 - DNA, 628 bp, Homo sapiens
  misc_feature: GZ8MTXP02FY59A.19.71.G05.1.454.CMB.2.raw
  modified_base (324)..(324): a, c, t, g, unknown or other
  modified_base (569)..(569): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtgaacgccctcgcacgacccctctcgctcacctgtcgccagtccgtccggggacagagtcgacgtagcgacagttgttgcttggctacgtgggtcaggcacgtcccagtcgagagtcagngtggcgtagggagactattatttacacttcgtccgaaacgtacggtacgaaaataacgtaaaattcgtacgacctaactaattcgtagttacgagtaacgtccgaagtacgaactaacgtactaaaacgtacgaactactaagtacgaaaaccgaccctaacgttcccacccgtagacgtaacgtcgtaccgtaacgtctacggtaccgtaacccgtacccgggaaggtacggtaaccggggttntaaacgttaagtttaacggacggttaacgggaccgtaaccggacccctaattaaaccgg

SEQ ID NO: 431300 - DNA, 755 bp, Homo sapiens
  misc_feature: GZ8MTXP02JVWDT.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtagaacgcccctcgccacgaccctctcgctcacctgtgcccagtccgtccggggacagagtcgctagcgacagttgttgcttggcacgtgggtcaggccacgtcccccagtaccggagtaggttctaggaggtgggcgtaggggaaagactagtttaactttcgattcggtaccctaaacgtacggttaaggaaaacttaaccgtaaaatttcgtaccgaacctaacccgtaatttccgttaggtttaggaaacggtacggttacccggaacgttacggaaaactaaacgttaaccgaaaacggttacgaaaccaacgtaaacgttaaccgaaaaccgtaaacccgtacgtttacccctaccccgttacggacctaacggtccttaaccgggtaccctttacggttccggtacgggaaacccccgttacccccggggaaagggtaacccgggttaacccgggggttacttaaaagtttaacccggtttacggtaagggggttaacgggaaaaccggttacccccgggtaaccccctaaagggttaaacccg

SEQ ID NO: 431301 - DNA, 555 bp, Homo sapiens
  misc_feature: GZ8MTXP02IECBU.19.71.G05.1.454.CMB.2.raw
  modified_base (453)..(453): a, c, t, g, unknown or other
  modified_base (507)..(507): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgcccatcgtccggggacagagtcgctagcgacagtgttgcttggcacgtgggtcaggcacgtccccatcgagaggtctagagtggctggggaagacattatttcatcgtccaaacgtacggtaggaaataacgtaaaatttatgactaccatcgtgttagagtagtcgaactgaacaatcaaacgtagacacgaatacgaaagaacctagttaccncctgacagcgtagaccctgtacgtacgaccttacccggaggaccgacggggttntaacgttaacgttcgtaggttacggaacgaccggacccctaagtaacg

SEQ ID NO: 431302 - DNA, 614 bp, Homo sapiens
  misc_feature: GZ8MTXP02HXCXZ.19.71.G05.1.454.CMB.2.raw
  modified_base (417)..(417): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgcctcacctgtcgccatccgtccggggacagagtcgctagcgacaggtgttgcttggcacgtgggtcaggccacgtccccagtcgagaggtctaggagtggcgtaggggaacgacattattcatcgtaccaagacggtaggaaactaaacgaaatttagacgactaacctattcgtagttagagtacggtacagtagaaacaatacaaacggtanaacacgaatacgaaacgaacctaacgttaccctaccgtacgacgtacgtccgtacgtaccttcgtacgtacgacccgtaccggacggacgtacggtagttacgtacgttaacgtcggtacggtaacggaccgaccccgtaagtacgacctaacgtccgaacctaccgtccgttccgtcgtacggtcgtacgttacgg

SEQ ID NO: 431303 - DNA, 801 bp, Homo sapiens
  misc_feature: GZ8MTXP02ICPJU.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctccgcctcaccgtgtcgccacgtccggtacccggggacaggacgtccgacgtacggccgtacgtaggttcggttcggtcgtttcgggaccgtaccggttcggggtaccacggggtacccaacggttcccccgaaggttccgggaaacggtacgggttaccgtaagggtacgggtcggggacgttacgggggaaaagtacctagtttacgtttacgtagttacgtacccaaacgtaacggttaacggaaactttaaaccgtaaaatttctacgaaccctaccgtaagttccttaggtttacggaagttacggtacgtaaacgttacgaaactaacgttaaccgaaaccgttaacggaaaccaacgtaaagtaccggtaaaagtaacccccgttagtttacccccgtacccgttacggtaccgtaaacggtccgttaaccgtaaccccgtttcgtacggtttaccccggaaccgtttaacccccggggaggtaaaccggttaccgggttagtttaaacgttaacgttttaacggaacggttacgggaaaccggtaccccgtaaccccgttaagaaccg

SEQ ID NO: 431304 - DNA, 616 bp, Homo sapiens
  misc_feature: GZ8MTXP02JAWPH.19.71.G05.1.454.CMB.2.raw
  modified_base (241)..(241): a, c, t, g, unknown or other
  modified_base (298)..(298): a, c, t, g, unknown or other
  modified_base (426)..(426): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcgaactgacaagtccagccacaatcttttanactacgttccaaacaatagaaaactacttagacttggtaccagcagagaccaggacngcctccgaggctgctcatttacctgggctacgtacgtaccccggggaaagttcccggggtccccctagaccgtatttccgagtcggcaggcgggtcgtggggacagtactttcactctccacgtaacncacgcacgctgacgacggatacgaagtgtggtcgtagttagtttatttagtacgtaactaaacgttaattattaacgttacgttacgttacggttacggtacggttaccggaacggtaaagggtaccgtaacgggtacgtaacttagtaacgtaaacggtaacgtaacgttggtacggtactacggtaac

SEQ ID NO: 431305 - DNA, 571 bp, Homo sapiens
  misc_feature: GZ8MTXP02JJEWU.19.71.G05.1.454.CMB.2.raw
  modified_base (236)..(236): a, c, t, g, unknown or other
  modified_base (309)..(309): a, c, t, g, unknown or other
  modified_base (541)..(541): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattcttttanacagttccaaacaatagaaaactcttagcttggaccagcagacacaggacagcctctaggctgctcatttacngggctatccgtaaccccggggatcccggggtccccctaggacccgtattccgaggtcggcaggtccgggtctggggactagtactttcacttctcaccatcagcacgccctgcgagggctaagaaagtgtggtggtactaagttttacttaagttcgtaacaaagtaattaagttatttaatacgttcgtacgggtcggttacggaccgaaagggtacctaagggtgagtanaacgaagaacgtacgtgtcggactaggacc

SEQ ID NO: 431306 - DNA, 625 bp, Homo sapiens
  misc_feature: GZ8MTXP02GKH52.19.71.G05.1.454.CMB.2.raw
  modified_base (235)..(235): a, c, t, g, unknown or other
  modified_base (247)..(247): a, c, t, g, unknown or other
  modified_base (280)..(280): a, c, t, g, unknown or other
  modified_base (420)..(420): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaanaatagaaaactacttagcttggtaccagcaganaccagacagcctctaggctagctacatttacgtgggcaattccgtaaccccggggaatcccggggtcctcggacccgattccaggtcggcaggtcggggtcctaggggactaggtatttccgacgttcctaccaacctancaaggcctaagccctgccgtaaggcctagaagagttggtaggacttagttttagttactttagtaacctaaataattaattaatttaattaacgtttaccggttaggtaccggtttacggaaccggtaaaacggggtaaccgtagggttacggattaaacgtacgaaggtaaaccgaacgttggtacggcttacggacctaaccg

SEQ ID NO: 431307 - DNA, 606 bp, Homo sapiens
  misc_feature: GZ8MTXP02F4L4Q.19.71.G05.1.454.CMB.2.raw
  modified_base (246)..(246): a, c, t, g, unknown or other
  modified_base (422)..(422): a, c, t, g, unknown or other
  modified_base (428)..(428): a, c, t, g, unknown or other
  modified_base (451)..(451): a, c, t, g, unknown or other
  modified_base (565)..(565): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtcgctagcgacngtgttgcttggcacgtgggtcaggcacgtccccagtccggagaggtcagaggtggcgtaggggaagactagttatttcattcgtaccaaacgtcggtaggaaacttacctaaaatttacagtacaaactattcgtagttagaaggtagtccgaatcgaaacaatactaaacggtanaactanagtacgaaactaactagtttccncccgtgacaagccttacgaccttgtacggtacgtaacccctaccgggaaggacgtacggggttataacgtttattaccgtaggtacggaaacggccggtaccccagtacgaacncgtacgccctaccgtgtaccctgtcggtacgtctttaaagg

SEQ ID NO: 431308 - DNA, 600 bp, Homo sapiens
  misc_feature: GZ8MTXP02IZR0E.19.71.G05.1.454.CMB.2.raw
  modified_base (231)..(231): a, c, t, g, unknown or other
  modified_base (241)..(241): a, c, t, g, unknown or other
  modified_base (383)..(383): a, c, t, g, unknown or other
  modified_base (426)..(426): a, c, t, g, unknown or other
  modified_base (445)..(445): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacatcaactgcaagtccagccanattcttttanactagttccaaacaatgaaaactacttagcttgaccagcagagaccaggacagcctactaggctagctactatttaccgtgggctacgtccgtaacccggggaattccccggggtccctggacccgtattccgagtcggacngggtcgggtctggggacagtactttcactctcaccatcagcanccctgccagtcagaaagtntggagtcttagtttatattactacaaatagttaattagtttatacgttgtacggtacgtttacgggacccgttaaaaggggaccctaaaggggtacggtaattaacggtccgaaaggtacccgtaaacgttcgggttaggccctttaggaacccc

SEQ ID NO: 431309 - DNA, 685 bp, Homo sapiens
  misc_feature: GZ8MTXP02IP1F4.19.71.G05.1.454.CMB.2.raw
  modified_base (288)..(288): a, c, t, g, unknown or other
  modified_base (295)..(295): a, c, t, g, unknown or other
  modified_base (319)..(319): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtcgtccggggacagacgtcgctagcgacagtgttgcgttgcacgtggtcaggcacgtcccagtcgagngtctagngtggcgtaggaacgatattacttnacgtacgtaccaacgtacgtaggaaaccttaacaaattacgtacgacctacctattcgtagtaggtacgtacgtacgtacgtagaaacgtaaacgtacgtaaaccgtaagaaccgaactaaacgttaaccgaaacgtaaaccgttacgtttccctaccgttcgacgtacgtcggttacccgtaccgtttacgtagggtaacccgtacccgtacccgggtaaaggtacggttaaacgggtcgttaaaattacggttacggtaagggtaacggaccgggtaacccgtaccccgtaaagttaccgaacgtacgtaacccgtaaccgtaccgtttcccgtacgttggtacggtacgtacgtttaaacggg

SEQ ID NO: 431310 - DNA, 568 bp, Homo sapiens
  misc_feature: GZ8MTXP02FNJ28.19.71.G05.1.454.CMB.2.raw
  modified_base (230)..(230): a, c, t, g, unknown or other
  modified_base (240)..(240): a, c, t, g, unknown or other
  modified_base (320)..(320): a, c, t, g, unknown or other
  modified_base (446)..(446): a, c, t, g, unknown or other
  modified_base (455)..(455): a, c, t, g, unknown or other
  modified_base (469)..(469): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccanaattctttanacagttccaaactaatagaaaactacttagcttaggaccagcaagagaccaggacagcctcgtaggctgctcatttacgnggcacgtccgtaaccggggtaatcccggtacggtcccctaggacccgtattcgaggttggcctagggcgggtctaggggactaggtactttcacttctccaccatcagcacgctgcagtctagaangtcggagtnttagtttatagttntaacaataattattaattatacgttgtaggacgttcggaacgtaaacggacctaagggtcgtaataacgtacgaaggtaacctagttcggtagcgtacg

SEQ ID NO: 431311 - DNA, 750 bp, Homo sapiens
  misc_feature: GZ8MTXP02FQVW2.19.71.G05.1.454.CMB.2.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccggccaccatccaactgacaacgtccagccaactaattctttatacacgttaccaataatagaaaactcttagcttaggtaccagacaagacgaccaggaccacgcctccgtaggctcgcctctagtttacgcgggactaccgtacccggtaacccggggtaacgttccccggggtaccccctacggacccgtatttccgagggtccggactacgggggtccggggtcgtagggggaacctacgggttaacttttccgaaacccttcccgtacctaacccctattaccgacgacccgaccgtcccctaggaccccgtaagggaccgttaaggaaagtagttgggtacggttacgtttaaagtttttaagttaacgttacgtaaacctaaactttaaatttaactttaattaaacgtttaccgttcgggtttaaacgggtaccggtttaccgggaaacccggtaaagggggttaaccgtaaagggttacggtaaacttaaggtaacgtaaacggtaacgtaaccgttggggtactaccgttacgtaacc

SEQ ID NO: 431312 - DNA, 555 bp, Homo sapiens
  misc_feature: GZ8MTXP02H3QLR.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatatttcatgtaccaacacgtagaactaacgaattatcgcaaccatctgttagagtacgtacgactaggaacaatacaaacgtagacacaatacgaaacgaacctaacgttcctaccctgacacgccgtacgtacctctagtcgacccgtcccgaggacgtaacgggtgtatacgttacgtagtagggaacgacggacccccgaatacgactatcgaacccgtacctacgtctacgtcgtacgtacttaacg

SEQ ID NO: 431313 - DNA, 643 bp, Homo sapiens
  misc_feature: GZ8MTXP02GOWAN.19.71.G05.1.454.CMB.2.raw
  modified_base (403)..(403): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtagaacgtccctcgacacgtaccctctcgctcacctgtcgccagtccgtccggggacagacgtcgctaggcgaactgtgttgcttggctacgtgggtcaggcctacgtccccagtacggagacggtcgtaggtggtggcgtaggggaagctattacttcagttcgtcccgaaatacggtagaaactaactaaagtttacncgacaccttatcgttagtaggagacgtacgaatacggaactaacttacgaaacgtagaaccaacgtagtaacgaaacggtaaccctaccgttaccctaccgtaggaccaacgtcccgtacgtacccctttcgtacgggtaccgacccgttaccccgggaagggtacccgtaagggttacgttaaattaacgtttacgtagggtaaacggtaccgaacccggtacccgttaaagaacccgg

SEQ ID NO: 431314 - DNA, 705 bp, Homo sapiens
  misc_feature: GZ8MTXP02G4F2G.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtcgaacgccctcgccacgacccctctccgctccacctgtcgcccagtccgtccggggacaggacgtcgcgtagcgactacggtgttgctttggctacgtgggtcgacggccacgtccccagtccggaggtacggtctaaggacggttgggccgtagggggaaacggtacctaagtttacgtttacacgttcgtacccgtaaacgtacgggttaaaggtaaaacttaacctaaaagtttacgtacggtaccctaaacccttaagttcccgttaagggtttacggaagttacggttaccgacgttacgaaacctaaacgtaccgtaaaacggtacgaacctaacgtacgttaaaccgaaacggtaaacccttacgttccctaccccgtaggaccacgtaccgtacgtaccttcgtacggtacgtacccgtaccgggaaacggtaccgtacgggttattaacgtaacgttacggaggtacggaaacgtcccggacctagtaaccg

SEQ ID NO: 431315 - DNA, 722 bp, Homo sapiens
  misc_feature: GZ8MTXP02JF78R.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcactgtcgccagtcgtccggggacagacgtcgctagcgacagtgttcgcttggctacgtgggtcacggcacgtccccagtacggagtacggtctaaggaggtggcgtaggggaagactattacttacgacgttcgtaccgaaacgtacggtaaggtaaactaacgtaaaatttatacggtacctaaccgtaattcgttaggtttacgaaggtacgttaccgaacgttacggaaactaaacgtaacgaaaacggttaacgaaactaacgtaacgtaacggtaaaaccgtaaaacccgttacggtttacccctacccgttaggaccgtaacggtaccgttaccgtaccccgtttacgttacggtaccggtaaaccccgttacccggggaaacggtacccgggtaaacggggtttactaaaacggtttaaccgtttaacggttacggaaaccgggggttaaacgaccccgggttaaccccaaaggttaaacccgg

SEQ ID NO: 431316 - DNA, 697 bp, Homo sapiens
  misc_feature: GZ8MTXP02GIZBL.19.71.G05.1.454.CMB.2.raw
  modified_base (509)..(509): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccagtccgtccggggacagagtcgctagcgacagtgttgcttggctacgtgggtcagggcacgtccccagtccggaagaggtcctaagggacggttgggaccgttaggggaaaaggtacctaagtttacttttacgaagttacggttacccaaacgtacggtacggaaaacttaacctaaaaatttacgtacgacctaacctattccgtggtttacggaagtacgttcctaacgtgaaacctaactacaaacgtagaactaacaacgtacgaaacgtaacctacgttcctaccngacgtacgctacgtaccttcgtacggttacgacccgttaccggacggtaacggtaccggggttattaagttaacgtttacgtaggttaacgggaaacggaccgggtaccccctaagttaaccgaacgtacgtaccggaacccttaccgttaccggttccgtccggttaggtacgttacgtttaacggg

SEQ ID NO: 431317 - DNA, 711 bp, Homo sapiens
  misc_feature: GZ8MTXP02GGGNJ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcgaggtccaggactggtagaacgccctcgcacgaccctctcgctcactgtcgccacgtccgtaccggggacaggacgtcgctaggcgacgtaggttgttcgtcgttggctacggtgggtcaggccacgtccccagtcgaggtacggtcgtagaggtcggtacgtaggggaaacgtactattacgtttacgacgttcgtacccaaacgtaacggtaggtaaaactaactaaaattagtacgacctaacgtaattcgttaggttagaagtacggtacgtagtacgaaactaataccgaaacggtacaaacctaacgacgtaaccgaaaacgtaacccttaaccggttcccttacccggagtaccgtaacgttccgtaacgttaaccccgttgtaccggttaaccggtacccggttaaacccgggacgggtaacccggttaacggggtttattaacgttaacgtttaaccgggtagggttaaaccgggaaaccggtcccgggtaaaccccctaaggttaaacccgg

SEQ ID NO: 431318 - DNA, 672 bp, Homo sapiens
  misc_feature: GZ8MTXP02GZ3JI.19.71.G05.1.454.CMB.2.raw
  modified_base (224)..(224): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctntcgctcacctgtcgccatcgtccggggacagacgtcgctagcgactagtgtgcttggctacgtgggtcaggccacgtccccatcggagtaggtctaggagtgggctaggggaaacgtactaagttactttacaacgttcgtacccaaacgtaacggtaggaaaacttaacgtaaaagtttagtacgaccaacccttagttacgttaggttaggaagtacggtaccgtaacgttacgaaactaacgtaacgaaaacggtacgaaacacgtaagtaccgaaaacgtaaccctacgtttacccgaccctagacctacgtacgtacgtacccgttcgtacggttccggaacccgtacccggaacggtaccggtaacggggttactttaaacgttaacgtttaacgtacgggttacggaaacggtaccccggtaaccccgtaagtaaacccgg

SEQ ID NO: 431319 - DNA, 728 bp, Homo sapiens
  misc_feature: GZ8MTXP02HSA6P.19.71.G05.1.454.CMB.2.raw
  modified_base (142)..(142): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtnctgggcctcccacaaggtgtcctgtcacaagtacagctgcagcagtcaggtccaggactggtgaacgccctcgcacgaccctctccgctccacctgtcgccagtccgtaccggggacaggacgtcgcgtacggcgacgaggttggttgtcgtttggcgtacgtgggtcacggcctaccgtccccagtcggtaggacggtcgtagtacggtggacgtaggggaaaggtactattactttcgaacgttcgtaccgtaaacgtacggtaaacgtaaaacgttaaaccgtaaaagtttacgtacgaccctaaaccgtaagtttcgttagggttaacgtaggtacggttacggtaacttaacggaaactaaacgtaaccgtaaaacggttaacgtaaaccaacgtaaacgttaaccggaaaaccgttaaccgttacgttaccccttacccgtacggactaaccggtcctacgttaaccctcggttacggttaccgtaccgtaccccgggtaaggtaacccgtaggggttacttaatttaacgttacgtacgggtaacgggaaaccgtaccggtaaccccgtagtaaacccg

SEQ ID NO: 431320 - DNA, 580 bp, Homo sapiens
  misc_feature: GZ8MTXP02FRGIY.19.71.G05.1.454.CMB.2.raw
  modified_base (220)..(220): a, c, t, g, unknown or other
  modified_base (255)..(255): a, c, t, g, unknown or other
  modified_base (477)..(477): a, c, t, g, unknown or other
  modified_base (488)..(488): a, c, t, g, unknown or other
  modified_base (495)..(495): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgagccctgcacgaccctntcgctcactgtcgccatcgtcggggacagagtcgntagcgacagtgtgcttggctacgtgggcgaggcacgtccccagtcggagaggtcgtaggaggtggacggtaggggaacgtactattatttcatcgtaccacgtacgtaggaaataactaaattatagacaacctattcgtgttacggaggtacgttcgacttaggaactaagaccgtaagtaacgaactacacgtacgaaacgtaacctcgttaccctcccnggactgactanacccgtntcgtacgaccgtacccggaggtaaccgacggggttatacttacgtaacgtggaacgggaaccgtaccgacccgtaagtacgaacc

SEQ ID NO: 431321 - DNA, 562 bp, Homo sapiens
  misc_feature: GZ8MTXP02HXHPQ.19.71.G05.1.454.CMB.2.raw
  modified_base (234)..(234): a, c, t, g, unknown or other
  modified_base (244)..(244): a, c, t, g, unknown or other
  modified_base (325)..(325): a, c, t, g, unknown or other
  modified_base (358)..(358): a, c, t, g, unknown or other
  modified_base (367)..(367): a, c, t, g, unknown or other
  modified_base (425)..(425): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatacgaactgacaagtccagccanaattctttanacacgttaccaaacaatacgaaaactacttagcttaggtaccagacagagaccaggacacgcctcagctgctcatttacgnggcagtcgtaccggatccgggcccctgaccgtntcagtcgcnggccgggtatgggactagtatttcactctacacccagtacagcacggctcgcgacggntagagtgtggtgtattagtttatagtacgtaataaacttaatattaattactacgttggtacggtacgttacggaacgtaaacggtacgaaggtacgactacgtaacgaacgaacgtacgtaggtacgtcgtacacg

SEQ ID NO: 431322 - DNA, 647 bp, Homo sapiens
  misc_feature: GZ8MTXP02FMIP5.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccagtcgtccggggacagagtcgctagcgactagtgttgcgttggctacgtggtcaggcacgtcccatacgagacggtctaggtagtggcgtaggggaacgtactattatttcagttcgtaccaaaccgtaggtaaggtaaaacttaaactaaaatttacgtacgacctaccctaattcgttaggtttagaacgtacgtacgtaacgttaacgaactaaacgtaccgaaaacggttacgaaacaactaagtaccgaaaacgtaacctaccgttaccgtacccgtagaccgagtacctacgtacccgttcgtacgtacggtacccgtaccgggacgtaaccggtacgggttattaagttaacgttacgtacggacggtaaaccggaccgtaaccccgaagttaaaccg

SEQ ID NO: 431323 - DNA, 561 bp, Homo sapiens
  misc_feature: GZ8MTXP02FJFQY.19.71.G05.1.454.CMB.2.raw
  modified_base (381)..(381): a, c, t, g, unknown or other
  modified_base (427)..(427): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgttgcttggcacgtggtcaggcacgtccccagtcgagaggtctagaggtggcgtaggggaaggactattactttcattcgtccaaacgtacggtaggaaataacaaaattntgacacctatctagttgagtagtcgactagaacaatacaaacgtanaacacagtacgaaacgaacctacgttacctcctgctagcctacgaacctcgtcggtacgacccgtaccggacggaccgtacgggtgtaagttaacgttacgtacggtacggaacgaccggaccccaagtaaccg

SEQ ID NO: 431324 - DNA, 736 bp, Homo sapiens
  misc_feature: GZ8MTXP02IOKZX.19.71.G05.1.454.CMB.2.raw
  modified_base (272)..(272): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgacgccctcgcacgaccctctcgctcacctgtcgccactccgtccggggacagacgtcgctagcgacngttgtgcgttggctacggtcgggtccgacggccacgtccccagtcggaggtacggtcgtaggaggtggacgtacggggaacgactagttacgtttacacgttcgtacctaaacgtacggtaagtaaaacttaaaccgtaaattacgtacgaacctaaccgtatccgttagtaggtaagtacgtacgtacgttaacgaacctaaacgtaaccgtaaaacgtaacgaaaccgtaaccgtaacgtaaaccggtaaaccgtaaaccccgttaccgtttacccctacccgtacgacccgtaacggtcccgtaaccgtacccttacggtacggtacccggtaacccgtaccccggggtttaaacgggtacccggttaaccggggttaagttaaccggtttaacgttaacgggttacggggtaaacggggaaaacccggtaccccggtaaacccccggtaaagttaaaccg

SEQ ID NO: 431325 - DNA, 670 bp, Homo sapiens
  misc_feature: GZ8MTXP02HL4MU.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgccagacccctctcgctcacctgtcgccctacgtccgtaccggggacaggacgtcgacgtagccgacgtaggttgttgcgtttggctacggtgggtcacggccacgtcccagtcggagtaggtactaggagtggcgtaggggaagtactattacttctaagttacgaccgtaaacgtacggtaaggtaaacttaaacgtaaaattacgtcgaaccctaaccgtagtttactagggttacgaaagtacgttacggacttaacggaacctaaagtaccgaaagttacgaaacactaacgttaccgaaacgtaaccctcgttacctaccaggactaacgtcctacggtaacccttgtaccgggttacgacccggtaacggaacggtaaccgggtaaacgggtttacttaacgttaacgttacggtacgggaaacggaaccgtacccgtacctaagtacg

SEQ ID NO: 431326 - DNA, 610 bp, Homo sapiens
  misc_feature: GZ8MTXP02FMA5G.19.71.G05.1.454.CMB.2.raw
  modified_base (225)..(225): a, c, t, g, unknown or other
  modified_base (451)..(451): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgacccctntcgcctcacctgtcgccacgtccgtccggggacagagtcgctagcgacagtgttgtcgttggcacgtgggtcaggccacgtccccagtcgagcggtcagagtggcgtgggaagtacagtatttcgattcgtaccaaacgacggttagaaacttaacgtaaattatcgactaacctattcgttgttagaagtagtacgacttacgaacaaacttacgaaaacggtanaaacacgtaagtaacgaaacgaaacctacgttaccctacccgtagcaagtccgtcgaacccttcgtcgtacgaaccgtacccgagggtaaccgtacggggtacttaagtaacgttaaccgtaggtaacgggaaacggtacccggtaaccccagtaaacg

SEQ ID NO: 431327 - DNA, 661 bp, Homo sapiens
  misc_feature: GZ8MTXP02FUGM5.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtcgaacgccctcgcacgaccctctcgctcacctgtcgccacgtccgtccggggaacagacgtcgctacgcgactagtgttcgcgttggctacgtgggtcaggccaccgtccccagtacgaggtaggtcaggagtgggcgtaggggaacgtacgttatttacgagtacgtaaccacgtacgtaggaaacttaactaaattacgcgtacctactattcgtagttagagtacgtacgacgttacgaactaacgtaacgtaacgtaacgaaccaactaacgtaacgaaaccgtaaaccgtacgttaccctcccgtagtaccgtacgtcctacgtacccgttcgtacgtaccgtaacccggtacccggaaacggtaaccggttaccgggttagttaacgttaacgttaacggtacggtaacgggaaccgtacccggtaaccccgtaagttaaccgtaaaccg

SEQ ID NO: 431328 - DNA, 632 bp, Homo sapiens
  misc_feature: GZ8MTXP02HYKJE.19.71.G05.1.454.CMB.2.raw
  modified_base (232)..(232): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgaccctctcgctcacctgtgccatccgtccgggganaggagtcgctagcgacaggtgtgcgttgcacgtggcaggcacgtccccagtacgaggagtctaggtaggtggcgtaggggaagacgtatttacgtttacaacgtcgtaaccaaacgaacggtaggtaaactaaacctaaaatttcgaacgacctaaccgttaatcgttaggtttagaaggtacgttacgaactacgaaacctaaagtacaaacgtacgaacacaagtaacgaaaactaacgtacgttaccctccgagtacacgtacctacgtacctgttcggaccgtaacgtacccggaaggtaccggtaagggttctagtacgttacgtaggtacggaaacgccgacccaagtacgacacgtccgaaccgtccgtacgtctcgtcggtactcgtaacgg

SEQ ID NO: 431329 - DNA, 665 bp, Homo sapiens
  misc_feature: GZ8MTXP02GF1WG.19.71.G05.1.454.CMB.2.raw
  modified_base (251)..(251): a, c, t, g, unknown or other
  modified_base (614)..(614): a, c, t, g, unknown or other
  modified_base (645)..(645): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgcccgtgctgggcctccacaaggtgtcctgtcaacaagtacagctgcagcagtcaggtccaggactggtgaacgccctcgcacgaccctctcgctcactgtcgcatcgtccgggganagagtcgctagcgacagtgttgcttggcacgtgggtcaggcacgtccccagtcggagaggtcgtagaggtggacgtaggggaaaggactagttactttcgaattacgtaccaaacgtacggtaaaggtaaaacttaacgtaaaatttacgtacgaaccctacctaagttccgttggttaacgaaggtaacgtccggtaaacttacggtaaaacaacgtaaccgtaaacggtaacgaaacctaaacgtaagttaaccgaaaacggtaaaacccttaaccggttcccctaccgttacggacctaaggtcctacggtaacccttcgtacgtaccgacccggttaccgaacgggtaccgtacgggtnttaacgttaacgttacggtagaacgggaacncccgggaccctaagtaaacg

SEQ ID NO: 431330 - DNA, 682 bp, Homo sapiens
  misc_feature: GZ8MTXP02GWSP5.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagagtcgctagcgacagtgttgcttggcacgtgggtcaggcagtcccccagtccgagaggtctagagtggcgtaggggaaggacagtatttcagttcgtaccaacgtacggttaggaaactactaaaattagtacgactacccattccgttagttagacgtagttccgaacgttaggaactaaacttaccgaaaacggttacgaaccgtaactaagttaaccggaaaaccgtaaaccctacgggttttaaccctacccccgttgaccgtaaacggtcctacggtaacccttcgttaaggtccgttaacccgtaccccggagggtaaccgtaccgggggttattagttaacttaccggtagggttacggaaacggtacccgggaccccctaagttaccgacttaaacgcggaaccctaaccgtcggttctccgttaggtcgtactttaaccgg

SEQ ID NO: 431331 - DNA, 568 bp, Homo sapiens
  misc_feature: GZ8MTXP02F10VT.19.71.G05.1.454.CMB.2.raw
  modified_base (242)..(242): a, c, t, g, unknown or other
  modified_base (324)..(324): a, c, t, g, unknown or other
  modified_base (387)..(387): a, c, t, g, unknown or other
  modified_base (452)..(452): a, c, t, g, unknown or other
  modified_base (539)..(539): a, c, t, g, unknown or other
  modified_base (544)..(544): a, c, t, g, unknown or other
  modified_base (553)..(553): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccaccatcaactgcaagtccagccacaattctttaanactagttaccaaacaatagaaaactacttagcttaggaccagcagacgaccaggacagcctactaggctgctctatttacgnggctacgtccgtaacccgggaacgtcccggggtccccctacgaccgtattccgaggtcggacngggccgggtctggggacctagtactttccactctcaccatcagcagcctaggcaggctagaaagngtgtcggattagtttatatcgtacaatattattatactacgtacgtcggtacgttcggaccgtaaaggaccgtaggtacgattaacncgaanaccgtaagngtcggacttacgacc

SEQ ID NO: 431332 - DNA, 691 bp, Homo sapiens
  misc_feature: GZ8MTXP02JC8YB.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagacgtcgctagcgactagtgttgcttggcacgtgggtcaggccacgtccccagtcggagtacggtctaggacggtgggacgtaggggaaggtactagttactttacgagttcgtacccgaaacgtacggttaaggaaacttaactaaagtttacgtcgaccctacctaagttccgttaggttacgaaaggttacgtaccggtaaacgttacggaaacctaaacgttacgaaaacggttaacgaaacctaacgtaacgtaaaccgggtaaaacgtaacccttaaccggtttccctacccgtaggacctacggtaccctacgtaccctttacggtacggtacccgtaacccggttacccggaacggtaccggtaacgggttattaacgtaacgttacggtacgggtacggaacgtacccgtacccgtaagtaaccgg

SEQ ID NO: 431333 - DNA, 638 bp, Homo sapiens
  misc_feature: GZ8MTXP02FZ283.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgcctcacctgtcgccatccgtccggggacagagtcgctagcgacagtgttgcgttggcacgtgggtcaggcacgtccccagtcgagaggtctagagtggctcggggaagacattacgttcattcgtccaactacggtaggaaataacaaaatttgacgtacaactatctagttgagtagtcgaactgtaacaaatcgaaacgtacgaactaacaagttaacgaaaacgtaaaccgtaccgttacccgtacccgttacgacgtacgtaccgtacgtaacccttacgttcggtaccgtaaccggtaccccggtaaacgggtacccggttaaaccggggttgtttaaactaacgtttaacggtaacggttacggggaaacggtaaccggttaacccccgaaggttaaacccggg

SEQ ID NO: 431334 - DNA, 672 bp, Homo sapiens
  misc_feature: GZ8MTXP02HC0BK.19.71.G05.1.454.CMB.2.raw
  modified_base (245)..(245): a, c, t, g, unknown or other
  modified_base (286)..(286): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacngtgttgcttggcacgtgggtcaggccacgtccccatcgagnggtcaggagtggcgtaggggaagactagttatttacagtcgtaccaaacgacggttaggaaactaacgtaaaatttatacgacctaaccattccgtaggtttagaacggtagttaccggaacttaggaaacctaaataccgaaaacggtagaacaacgtaagttaccggaaaacgtaaccgtaacgttttcccacccgtaggacctaacgtccgtacggtaaccctcgttacggtacgtaccccgttaccggaaggtaccggtaccgggggtttataacgtttaagttacccggttagggaacgggttaaacggacccggtacccctaaagtacgaactacgtccgaacctaccgtcgtaccttgtacgggtactacgtttaacgg

SEQ ID NO: 431335 - DNA, 599 bp, Homo sapiens
  misc_feature: GZ8MTXP02JLQAL.19.71.G05.1.454.CMB.2.raw
  modified_base (130)..(130): a, c, t, g, unknown or other
  modified_base (388)..(388): a, c, t, g, unknown or other
  modified_base (443)..(443): a, c, t, g, unknown or other
  modified_base (517)..(517): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttnttcctgcccgtgctgggcctcccacaaggtgtcctgtcacaagtacagctgcagcagtcaggtccaggactggtgaagccctcgcagaccctctcgctcacctgtcgccagtctccggggacagagtcgctagcgacagtgttgcttggcacgtggtcaggcacgtccccatcggagacggtctagacggtggactaggggaacgacattaatttccgaatcgtacccaaacgacggtagtaaataaccaaatttaanacgactactagtcgtagtagagtacgtacactaagaactaacgtacgaaacgtanaaaccaactaacgtaccgaaacgtaacctacgttaccctaccgtgactacgcctacgtacccgttcgtacggtnttaaccgtaccggtaacggacgtacggtacgtaacgttaacgtaacgtacggtacggaacggaccgtacccgtaacgtaacg

SEQ ID NO: 431336 - DNA, 666 bp, Homo sapiens
  misc_feature: GZ8MTXP02JBRD8.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgtgcttggcacgtggtcaggcacgtccccagtcgagaggtctaggacgtggcgtaggggaagactagttactttcgagttcgtaccaaacgtacggtaggaaacttaacgtaaaatttatacgacctaacctagttaccgttagtttaggaagtaacgtccgtaacttagaaacctaaataccgaaaccggtaagaaccaacgtaacgttaaccgaaacgtaaaccctacggtttaccctacccgttacggaccacggtaccgtacggtaacccttcgttacgtaccggtaacccgttacccgggaacggtaccgtaaccggggttagttaaacgttaacgtttaacggtaggttaacgggaaacggacccgggtaaccccctaagttaaacccgg

SEQ ID NO: 431337 - DNA, 596 bp, Homo sapiens
  misc_feature: GZ8MTXP02GLGEL.19.71.G05.1.454.CMB.2.raw
  modified_base (238)..(238): a, c, t, g, unknown or other
  modified_base (253)..(253): a, c, t, g, unknown or other
  modified_base (256)..(256): a, c, t, g, unknown or other
  modified_base (328)..(328): a, c, t, g, unknown or other
  modified_base (464)..(464): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtnccatcgtccgggganagngtcgctagcgacagtgttgcttggcacgtgggtcagggcacgtccccagtcggagtaggtctagaggtcggngtaggggaagacattatttcgaatcggtacccaaagacgtaaggaaactaactaaaatttgacgacaacctatacgtgttagaagtagtacgatacgaaacaataccgaaaaggtacaacactaagaccggaaaanaacctagttacctccaggaccagtcctacgtaacctcctggtacgtacccgtacccgggagacccgtaacggggttattaagtaactttacggaggttaacggaaccgaacgggaccccttaaagtaaaccg

SEQ ID NO: 431338 - DNA, 598 bp, Homo sapiens
  misc_feature: GZ8MTXP02FLNJS.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctccacctgtcgccactcgtccggggacagagtcgctagcgacaggtgttgcgttggcacgtgggtcaggcacgtccccagtcgaggaggtctaggaggtggcgtaggggaaagactagttatttcagttctccaaacgagtaggaaataactaaagttatcgacactatctggtagagagtcgtaacgtagaactaactacaaacggtaacaacaacaacgtaacgaaacggtaaacctaacgttccctaacccgtgaccagtacctcgtaaccctcgtcggtaccgaccgtaccggaacggtaccgtacgggtacgttaataacgttacgtaggtacggaaacggaccggaacccctaaggtaaccg

SEQ ID NO: 431339 - DNA, 690 bp, Homo sapiens
  misc_feature: GZ8MTXP02IKZWQ.19.71.G05.1.454.CMB.2.raw
  modified_base (237)..(237): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggtactggtgaacgccctcgcacgacctctcgctcacctgtcncctacgtcgtaccgggacagacgtcgactacgcgacgtagttcgttgtcgttcggctacgtggggtcacggcctacgtccccagtcggaggtgtactaggagtggacggtgggaacgactattattcattacgtaaccacgtacggtaaggtaaactaaactaagttacgacgacctaactgtaccgtttagacgtagtagttaccgtacgtaaggtaacaaaacgttacgaaccgttaagaaccaacgtaaacgtaaccgaaaacgtaaccgttaacccgtttcccgaccctacgggtaactacggtcccgttaacgtaacccgttcgttcggtaaccgttaccggtacccgtaaacgggggaaccttacgggggttaaacgttactttaaaacggttcgttaacggtaagggtaaacccgacgggtacccctaaacgtaacgtaaacccgg

SEQ ID NO: 431340 - DNA, 679 bp, Homo sapiens
  misc_feature: GZ8MTXP02IUR46.19.71.G05.1.454.CMB.2.raw
  modified_base (500)..(500): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtcgaacgcccctcgcacgaccctctcgcctcacctgtcgccacgtccgtccggggacaggacgtcgctagccgactagttgttgcgttaggctacgtgggtcacggccacgtccccagtacgaggtacgtcgagtggtcgtggaacgggacgatagtttctactagtcgtaccgaacgtacggtaaataccgtaaattaagttcgtaacgtaccctaaagttcgttacgttaggtacggtaacgtcggtacgtacgtaacgtaactacgtaaaccgtaaacgacaaacgtacgtaanaaacggtaaccgtaacgttccgtaccctacgacacgtacgtacgtaccgtacccgttaggtaccgtaccgtaacccgggtaccggtaaacggtaccggggttacgttaaccgtttaaagttaaccggttaaagggttcggaaacgggtaacccggcccccgtaaacgtaacggtacccg

SEQ ID NO: 431341 - DNA, 669 bp, Homo sapiens
  misc_feature: GZ8MTXP02FZE5K.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtcgaacgccctcgcacgaccctctcgctcacctgtcgccagtccgtcggggacagacgtcgcgtacgcgacgtagtgtcgcgttggctacgtgggtcaggcctacgtccccagtaccggaggtacggttacgtaggaggtcgggacggtaggggaaacggtacctagtttacgtttacacgttacgtaccgaaacgtaacgggtacggtaaaacttaacttaaaagtttacgtacgtacctaactattcgttaggttagaagtacgtactaacgtagaactaaactaacgtaaagtacaaactacgtaacgtacgaaaacgtaacctaccgtttaccctaccgtagaccgtacgtaccgtacgtaacccttcggtacgtacccgtacccgaaccggtaacggtaccggtaacgggttattaacgtaagtttacggaaggtacggaacgaccgtaccctagtaacg

SEQ ID NO: 431342 - DNA, 597 bp, Homo sapiens
  misc_feature: GZ8MTXP02HGROL.19.71.G05.1.454.CMB.2.raw
  modified_base (245)..(245): a, c, t, g, unknown or other
  modified_base (328)..(328): a, c, t, g, unknown or other
  modified_base (442)..(442): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccaataattcttttanacagttacccaaacaatagaaaactcttagcttggtaccagcaagacgaccaggacacgccctcgaggctgctactatttcgnggacacttccgaaccccggggtactccccccggggtaccctggacccgtattcgagtggccagggcgggtcgtggggactagtactttcactcctacaccatcacgcacgtccngaccgaggctagaagtacgtggtacgacgttagtttagttattacgtacaaattaattatttaattattacgttcggtacgggtacgttacggaacgaaacgggtaccgtaagggtcgtaataacgtacgtaagacgtaacgtggtacgtctacg

SEQ ID NO: 431343 - DNA, 671 bp, Homo sapiens
  misc_feature: GZ8MTXP02GEE89.19.71.G05.1.454.CMB.2.raw
  modified_base (246)..(246): a, c, t, g, unknown or other
  modified_base (258)..(258): a, c, t, g, unknown or other
  modified_base (325)..(325): a, c, t, g, unknown or other
  modified_base (390)..(390): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgactacgaacgtgactaagtccagccatattctttanacagttaccaanaatgaaaactctagcttaggaccagcagacgaccagacagcctacgtagctgcctatacgtttacgnggcacttcccgtaacccggggtaacttccccggggtaccctggacccgtattccgaggtcgacgngggtcggtcgtaggacagttacttccactcacctacgtacacgacgtaccgacgtccgtagacgtacgacgtaaggtaacgtgttacggtacggttacgtttaaagttttacgttaacgttaacgtaaactaaaacgtttaaattttaacgtttaactttaacggtttacgttacgggttacggtttacccggtaccgggtaaccggtaaaacgggtaccgtaaaggtacgtaaagttacgtaacgtaacgtaacgtacgtacgtacggtacgtacgtacg

SEQ ID NO: 431344 - DNA, 631 bp, Homo sapiens
  misc_feature: GZ8MTXP02HMSET.19.71.G05.1.454.CMB.2.raw
  modified_base (244)..(244): a, c, t, g, unknown or other
  modified_base (351)..(351): a, c, t, g, unknown or other
  modified_base (449)..(449): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccacatcaactgacaagtccagaccactaattcttttaanactacgttaccaaactaaatacgtaaaactacttagcttaggtaacccagcaagaacgaacccgaaggaccacggcccctacgtaaggcctgcctactattttacgngggacagtaccgtacccggggaactccccccggggtcctagaccgtatcgaggtcgcgaggcgggtctggggacagtacttccactcaccacatcgancacgcctgacaggtacaggtaagagttcggttaggacttagttttaattagttacgtaaacaaattaaatttaatttaatttaacgttaccgtttcggtaggttacccggttacggaaccgtaaagggggaacctaaggggttaccgaataacgtacgacgaacgtaacgtgacggtcaacg

SEQ ID NO: 431345 - DNA, 619 bp, Homo sapiens
  misc_feature: GZ8MTXP02HQ5N3.19.71.G05.1.454.CMB.2.raw
  modified_base (400)..(400): a, c, t, g, unknown or other
  modified_base (500)..(500): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcacacgaccctctcgctcacctgtcgccagtccgtccggggacaggacgtcgctacgcgactagtgttgtcgttggcacgtgggtcaggcacgtccccagtcgagacggtctaggagtggacgtaggggaagactattactttcacttgtacccaaagtacggtaggtaaacttaacgtaaaatttnacgacctaacctattcgttagttacgagtacgtacgtactagtaactaactacgaaacgtagaactaacgagtaccgaaagaaccctcgttacctaccgngacgacgtctcgaccctcgtacgtaccgacccgtaccgggaacggaccgtaacggggttctaaacttaacgttaaccggtaggttacggaaaccggtacccggacccctaagtaaccgg

SEQ ID NO: 431346 - DNA, 632 bp, Homo sapiens
  misc_feature: GZ8MTXP02GU5PG.19.71.G05.1.454.CMB.2.raw
  modified_base (235)..(235): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtgaacgccctgcacgaccctctcgctcactgtnccatcgtccggggacagacgtcgactagcgactagtcgtgcttaggctacgtgggtcaggcctacgtccccagtcggaggtacggtctaggagtggcgtaggggaagtactattactttcattcgtaccaaacgtacgtaggaaactaactaaattatacgacctacctagttcgtagttagaacgtacgtaccgtaagtacgaaactaacgtaccgaaaacggtacgaactaacgtaacgtaaccgaaacggtaaaccctacggtttacccacccgttaggacctacggtccgtacgtacccttacgttacggtacgtacccgtacccggaaggtaccgtaacgggtttataacttaacgttcgtaggtaacgacgtacccgaccctaagtaaccg

SEQ ID NO: 431347 - DNA, 676 bp, Homo sapiens
  misc_feature: GZ8MTXP02JXVOD.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgctcacctgtgccatccgtccggggacaggagtcgctagcgacagtgttgcttggcagtgggtcaggcacgtccccagtcgaggaggtctaggagtggcgtaggggagactattatttcagtcgtccaaacgtacgtaggaaataacgtaaattatacgactaacccgtataccgttggtgaagtacgtaccggtaactacggaaactaactaccgtaaaacggttacgaaacctaacgtagtaaacccggaaaacggtaaacccgtacggtttaacccctttaccccgtacgggacctaacgtaccgtacggtaacccctttcccgtttacgggaccggtaaccccggttaccccgggaaacggtaccggtaaccggggttaagttaacgttaacgttaccgttagggttacggggaaacgtacccgggtaccccctaagtaaaccgg

SEQ ID NO: 431348 - DNA, 590 bp, Homo sapiens
  misc_feature: GZ8MTXP02FWE9H.19.71.G05.1.454.CMB.2.raw
  modified_base (231)..(231): a, c, t, g, unknown or other
  modified_base (240)..(240): a, c, t, g, unknown or other
  modified_base (248)..(248): a, c, t, g, unknown or other
  modified_base (252)..(252): a, c, t, g, unknown or other
  modified_base (261)..(261): a, c, t, g, unknown or other
  modified_base (312)..(312): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcgaactgacaagtccagccanaatctttanacatcaanatanaaactctancttagacagcagacgaccaggacacgcctcgaggctcgctactatttacgnggactactaccggtaccggaacgtccggggtcccctacgaccgtattcgaggtcgacgcgggtcgggtcgagggacagttacttccactcaccaccagtacagcacgcctgacgacgactagaagagtgtaggtacgttagtttattagttacgtactaaactaattaattaattaacttacgttacggttacggtacggtacggtacggtaaacggtaacgtaacggtagtaagtagtaacgtaacgtaacgtacgtacggtacgtacgtacgtacg

SEQ ID NO: 431349 - DNA, 668 bp, Homo sapiens
  misc_feature: GZ8MTXP02JOOS6.19.71.G05.1.454.CMB.2.raw
  modified_base (286)..(286): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcgttggcacgtgggtcaggcacgtccccatcgagnggtcagagtggcgtagggaagacattatttcattcgtaccaacgtacggtaggaaacttacgaaaatttatagccaacctatcgtgttagagtagtcgactagaacaatacaaacgtagacacaatacgaaacgaaacctacgttacctacccgtacgaccgtacgtaccgttacgtaacccttcgttacggtaccgtacccgttaccccggaacgggtaaccggtaacgggtttagttaaagtttaacgttaaccggttacgggttaacggggaaaccgggtacccggtaacccccgtaaagttaaccggaactaacgtaccggtaaccctaacccgtttccggttaccgttacggtcggttaccgtaccgttttaaacgg

SEQ ID NO: 431350 - DNA, 559 bp, Homo sapiens
  misc_feature: GZ8MTXP02I6PT1.19.71.G05.1.454.CMB.2.raw
  modified_base (291)..(291): a, c, t, g, unknown or other
  modified_base (418)..(418): a, c, t, g, unknown or other
  modified_base (430)..(430): a, c, t, g, unknown or other
  modified_base (446)..(446): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccttccacaaggtgtcctgtcacaagtacagctgcagcagtcaggtccaggactggtgaagccctcgcagaccctctcgctcacctgtgccatccgtccggggacagagtcgctagcgacagtgtgcttggcacgtgggtcaggcacgtccccatcgagagtctagngtggctaggggaagactagttatttcattcgtaccaacgtacggtaggaaactacaaattatcgacaccatcgtagttgagtacgtcgactagacaatcaaacgtagacacagtacgaacgaacctntcctacctgacngactcactcgtgtacncccgtaccggaggtacgtcggtagtatagttacgtaggacggaaccgtccggaaccctaagtacgacctacgtaccgcctaaccgttcgtcgtcgttaggtctacctttaagg

SEQ ID NO: 431351 - DNA, 666 bp, Homo sapiens
  misc_feature: GZ8MTXP02IH13I.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtagaacgccctcgacacgacccctctcgctcaccctgtcgccatccgccggggacaggacgtcgctacgacgacgtagtgttcgcgttggctacggtgggtcaggccacgtccccgatcggaagtgtcgtaagcggtggagtaggggaaacgtactattagtttcagttcgtacccaaacgtacggtaggtaaaattaactaaaattagtcgaaccaccgtaaagttcgttagttagagtacgtacaactgaacctaatacgaaacgtagaaccaagtacgaacgaaagtaaacctacggttcctaccctggaccaacgtccgtacgtaacccgttgtacgttacggaacccgtaaccccgggaaaggtaccggtaaccggggtagtttaaaaccttaagtttaaacggacgggttaaacgggtaaaacccggacccggtaacccccttaaaagtaaacccgg

SEQ ID NO: 431352 - DNA, 645 bp, Homo sapiens
  misc_feature: GZ8MTXP02FRZHM.19.71.G05.1.454.CMB.2.raw
tcagtactctcgtgcacgaccggtgctcgatttagtgtcgtcgcaagagagagggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatccgtccggggacagagtcgctagcgactagtgttgcttggcacgtgggtcaggcacgtccccatcgagagtctaggagtggcgtaggggaaggactagttatttcatcgtacccaaactacggtaggaaactaactaaaattatcgaccaccgtattcgtggttagaaggtacgtacgaacttaggaaacaaactacgtaaacgtaagaaccaacaacgtaacgaaacgaaaccctaacgtttcctaccccgtgaccgagcctacgtaccctcgtacgtacgacccgtacccggaaggaccggtaagggttacgtaagttacgttaacgtggtacggaaccggacccggacccccgaagtacgaacgtacgtaccgaaccccgtacccgttccgttccgttccgtcggttacgtacgtttaaacg

SEQ ID NO: 431353 - DNA, 654 bp, Homo sapiens
  misc_feature: GZ8MTXP02J2CRC.19.71.G05.1.454.CMB.2.raw
  modified_base (240)..(240): a, c, t, g, unknown or other
  modified_base (245)..(245): a, c, t, g, unknown or other
  modified_base (257)..(257): a, c, t, g, unknown or other
  modified_base (267)..(267): a, c, t, g, unknown or other
  modified_base (271)..(271): a, c, t, g, unknown or other
  modified_base (279)..(279): a, c, t, g, unknown or other
  modified_base (313)..(313): a, c, t, g, unknown or other
  modified_base (322)..(322): a, c, t, g, unknown or other
  modified_base (382)..(382): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtcctccagacctccctggctgtgtctcgtgggcgagccgggccaccatcaactgacaagtccagccactattntttanacagttaccaanatagaaactnttancttagacngcagacaccaggacacgcctcgtaggctgacctntatttacgnggaccacgtcccgtaaccgggagtccccggggtccccaggaccctattccgaggtcggcncggggtcggtcgtaggacctagtactttcacctcgtaccaccgtatacgacgccgacgtccgacgacgtaccgggtactaacggaaacggtgttgggtacggtcttaaggttttacttagttacgtaaaccgtaaattaaagtttactttaagtttacctaaacgtttcggtaacggtacggtttaaccgggaccgtttaaaacgggaccgtaacgggttacgtaacgtagtaaccgaacggtaacgtaacgttggacggtccaggtaaccc

SEQ ID NO: 431354 - DNA, 620 bp, Homo sapiens
  misc_feature: GZ8MTXP02FHG0T.19.71.G05.1.454.CMB.2.raw
  modified_base (331)..(331): a, c, t, g, unknown or other
  modified_base (380)..(380): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtcgtcctgtcacaagtacagctgcagcagtcaggtccaggactggtgaacgccctcgcacgaccctctcgctcacctgtcgccatccgtccggggacaggacgtcgctagcgacaggttgttgcgttggcacgtgggtacaggcacgtccccatcgagaggtctagagtggngacgggagacattacttcagtgccaacgacgtagaaataactaaaattntacgaccacctatcgttagttagagtagtaccgagtacgaactaatacgaaacgttaagaaacctacgaactaacggaaaacgtaaccctaccggtttaccacccgtacgaccgacgtaccttacgtaaccccttcggtacgttaccggaacccgtcccgggaaacggaaccggttagggtacttaagttaacgttaaccgtaggtaacgggaacgtaccccggaaccccaggtaaaccg

SEQ ID NO: 431355 - DNA, 677 bp, Homo sapiens
  misc_feature: GZ8MTXP02FOJER.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccactcgtccggggacaggacgtcgctagcgacagtgttgcttggcagtgggtcaggcacgtccccagtcgaggtaggtcgtaaggagtcggggacgtaggggaaaacggtacctaatttactttacgaacgttcggttaccccgaaacgaacgggttaaggtaaaacttaaacctaaaattttagtcgacctaaaccgtattccgttaggtttaggaacggttacgtaccgtaaacgtaaggtaacctaaaaagtccgtaaaacgtaacgaaacctaacgtaaacgttacccgaaaagtaacccttacggtttcccttacccgaggtaccacgtactacgtaaccctcgttacgacgtacccgtaccggaggtaaacccgtaggtcgttaaagttaacgttcggtaggtaccggaaagccccggttaccacggtaacg

SEQ ID NO: 431356 - DNA, 655 bp, Homo sapiens
  misc_feature: GZ8MTXP02HYSTC.19.71.G05.1.454.CMB.2.raw
  modified_base (225)..(225): a, c, t, g, unknown or other
  modified_base (564)..(564): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgccctcgcacgaccctcnccgctcacctgtcgccagtccgtccggggacaggacgtccgactacgcgaacgtaggttgttcgtcgttggcctaacggttcggggtacgacggccgtaccgtacccccaggttaccgaggtacggttacgtaggtaaggtcgggacgttagggggaaagtacctagttactttacgaacttacggttaccaaacgtaacgtacggtaaaacttaacgtaaaactttagacgtacaaccttagttcgtagttgaacgttacgacgtaactagaactaaagtacaaacgttacgaataacgtaacgttacgaaacgtaaccctacgttccctacccgtanacgtacgctacgtacctcgtacgtacgccgacggaacggtccggtacggtataagttaacgtaggtaacgacggaacgtccgacctaagcg

SEQ ID NO: 431357 - DNA, 528 bp, Homo sapiens
  misc_feature: GZ8MTXP02HD7Q2.19.71.G05.1.454.CMB.2.raw
  modified_base (419)..(419): a, c, t, g, unknown or other
  modified_base (505)..(505): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagagtcgctagcgacagtgtgcttggcacgtgggtcaggtcagtccccatcgagtagtctagagtggcgtaggaaggacatactttacatcgtaccacgtacgtagaaatactaaattatcgacaccatctgttagagtagttcgacctagaacaaatacaaaacggtanaacaacaagttacgaaagtaacctacgtactacccgtgcacgctagacctctacgcgaccccgaggacacgggtctactagtacgngtagacgacgacccatacgacag

SEQ ID NO: 431358 - DNA, 654 bp, Homo sapiens
  misc_feature: GZ8MTXP02IQDYZ.19.71.G05.1.454.CMB.2.raw
  modified_base (235)..(235): a, c, t, g, unknown or other
  modified_base (245)..(245): a, c, t, g, unknown or other
  modified_base (270)..(270): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtcctccagacctccctggctgtgtctcgtgggcgaggcggccaccatcaactgaccaagtccagccaanattcttttanactacgttcaaataatagaaaactnttagcttaggaccagcagagaccaggacagcctcgaggctgctctatttacgggctacgtaccgtacccggggacgtcccggggtcccctaggaccgtattcgacggttggcctggggtcgggtccgtaggggactagtactttccaacttcgtccaactatacgtacgaccagtccctgacgacggcctaaggaacgttagtcgggtcgtactttaagttttattagttcgtaaactaaattaatttaaagtttacttaacgtttacgttacggtaacgggttacgtacccgggtacggtaaaaccggggtaactaacggggttacgtatttaacggaagtaaacgggaaccgttaagtcgggtaccggtactaccggtaacc

SEQ ID NO: 431359 - DNA, 594 bp, Homo sapiens
  misc_feature: GZ8MTXP02FLYU5.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggcgtaggggaagactattatttcatcgtaccaaacgtacggtaggaaactaactaaaattatacgcaacctattctggttagaggtacgtcgtactagaactaaatacgaaacgtagaacaacgaatacgaaacgtaaacctacgttacctacccgtcgcacgtcgtacgtacctctcgtacgaccgtacccggacggacggtacgggtagttactagttacgtaggtacggaacggaccgtacccagtacgactacgtacgaaccctaccgtcgtacctcgtcggtacgtacgttacg

SEQ ID NO: 431360 - DNA, 669 bp, Homo sapiens
  misc_feature: GZ8MTXP02HDLF7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagacgtcgactagacgactagtgtgcgttaggctacgtgggtcaggccacgtccccatcggagtagtctagtagtggcgtagggaacgactattactttacagttcgtaccgaaacgtacgtaaggtaaaacttaaactaaaagtttacgtacgaacctaacccgtagtttaccgttaggtttaggaacgggttacgttaccgaacgttaggaaacctaaagtaacccgaaaacggttacaaaccgtaaactaaacgtaaccgaaaaccggtaaacccttaccggttacctaccccgttagaccacgtactacgtacccttcgtacgtacgaacccgtccggaaacggtaccgttaacggttataacttaagttacggtaggtaacggaacgtaccggaccccttaagtaaccg

SEQ ID NO: 431361 - DNA, 594 bp, Homo sapiens
  misc_feature: GZ8MTXP02JUBB8.19.71.G05.1.454.CMB.2.raw
  modified_base (376)..(376): a, c, t, g, unknown or other
  modified_base (428)..(428): a, c, t, g, unknown or other
  modified_base (443)..(443): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccacaatctttatacagttccaacaatagaaaactactagcttggtaccagcagagaccagacagcctctaggctgctctatttacgtggctactccgtaaccccggggaagtccggggtcccccctaggaccgtattcgagtcggacgnggcgggtcgtaggggactagtactttcacttctcaccatcgagctagcccgngacgacgcagaagtntgtacgtattagtttacttatacgtaactaaataattaatttaacttagttacgttacggttacgggttaccgttacgggaaccgtaacggggtaaccgtaggggtacgtaatacgtaacgtaacggaacgtacgtggcggtactacgacc

SEQ ID NO: 431362 - DNA, 563 bp, Homo sapiens
  misc_feature: GZ8MTXP02GAB1M.19.71.G05.1.454.CMB.2.raw
  modified_base (237)..(237): a, c, t, g, unknown or other
  modified_base (249)..(249): a, c, t, g, unknown or other
  modified_base (276)..(276): a, c, t, g, unknown or other
  modified_base (306)..(306): a, c, t, g, unknown or other
  modified_base (316)..(316): a, c, t, g, unknown or other
  modified_base (379)..(379): a, c, t, g, unknown or other
  modified_base (390)..(390): a, c, t, g, unknown or other
  modified_base (394)..(394): a, c, t, g, unknown or other
  modified_base (421)..(421): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccggccaccgatcaactgcaagtccagccatatctttanacagttaccaanaatagtaaaactatagcttagtaccancagacgaccaggacagccctcaggctgctntaatttacgngggcaacgttccgtaaacccggggactccccggggtacctaccgacccgtatcgaggtggacngggtccggtgngganacgttattcaactctccgacactcgancacgccctggacgacggtgagaagtatggagtacgtagtttatagttacaactaataatacgtttatagtacgtgtagtacgttaccgagtaaaccggagaggtatatagtacgaagtacgaacgtcggagtccagcctaac

SEQ ID NO: 431363 - DNA, 562 bp, Homo sapiens
  misc_feature: GZ8MTXP02FJIBI.19.71.G05.1.454.CMB.2.raw
  modified_base (269)..(269): a, c, t, g, unknown or other
  modified_base (330)..(330): a, c, t, g, unknown or other
  modified_base (348)..(348): a, c, t, g, unknown or other
  modified_base (375)..(375): a, c, t, g, unknown or other
  modified_base (427)..(427): a, c, t, g, unknown or other
  modified_base (473)..(473): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggctacgtgggtacnggcacgtccccagtcgagaggtctaggagtggcgtagggaagcattattcagtcgaccaancgtagaactactaaatangacacatctgttgagtagtcgtaacgngaacaatactaaacgtagaacacagtacgaaactaactacgttcctaccgtnacagtctacgtacctctagtacgaccgtaccgaggacgtacgggtnttaatattacgtggtacggacgaccgaccccaagtacgactagtccgaacccgtaccgtccgtacgtcgttacggtcgtactttaacgg

SEQ ID NO: 431364 - DNA, 526 bp, Homo sapiens
  misc_feature: GZ8MTXP02FHM0M.19.71.G05.1.454.CMB.2.raw
  modified_base (415)..(415): a, c, t, g, unknown or other
  modified_base (438)..(438): a, c, t, g, unknown or other
  modified_base (471)..(471): a, c, t, g, unknown or other
  modified_base (513)..(513): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcacgtccccatcgagaggtctagagtggctggggaagcatattcatgtaccaaagacgtggaaactactaaaattatgacaccatctgttgaagtagtcgactgaacaaatacaaacgtagaacacataacgaaagaaacctacgttcncccctgcagactcgacctctagnacctacccggaagacgacgggtatatagttacnggtagaagacggccccagtacgacagtcaaccgtctcgtacncgtagcgcttaag

SEQ ID NO: 431365 - DNA, 680 bp, Homo sapiens
  misc_feature: GZ8MTXP02IHO26.19.71.G05.1.454.CMB.2.raw
  modified_base (614)..(614): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccagtccgtccggggacagagtcgctagcgacagtgttgcgttggcacgtggtcaggcacgtccccagtccgagtaggtctaggaggtggcgtaggggaaggactattactttcagttcgtaccaaacgtacggtaaaggtaaaacttaacgtaaaatttagtacgaccctaacctagttacgtaggtttacggaagtacgtccgtaacgttacggaaactaaacgtaccgaaaacggttaacgaaaccaaacgtaacgtaaccgaaaaccggtaaacccttacgttaccctacccgtagaccgtacggtacctacgacccttacgtacggtacgaaccccgttacccgggaaacggtaccgtaaccggggttnttaaacgttaacggtttaaccgtagggtaacgggaaaaccgtacccggtaaccccgtaagtaaccg

SEQ ID NO: 431366 - DNA, 530 bp, Homo sapiens
  misc_feature: GZ8MTXP02FOSNC.19.71.G05.1.454.CMB.2.raw
  modified_base (349)..(349): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgcctcacctgtgccatctccggggacagagtcgctagcgacagtgttgcttggcactgggtcaggcacgtccccatccgagaggtctagagtggctggggaagacatacttcatcgtccaaacncgtaggaataactaaattatacgtacaccatactgttagagagtcgactagacaatacaaacgtagactaacatacgaaacgtaaaccagttacctacctagcagactagacctctcgtcgactcccggacgtacgacgggtactagtaacttactacggtagaggacggaccccagtacg

SEQ ID NO: 431367 - DNA, 708 bp, Homo sapiens
  misc_feature: GZ8MTXP02IJ3UM.19.71.G05.1.454.CMB.2.raw
  modified_base (242)..(242): a, c, t, g, unknown or other
  modified_base (336)..(336): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctcagacctccctggctgtgtctcgtgggcgagcgggccacatacaactgacaagtccagccactaattcttttanactacgttaccaaataatagtaaaactacttagtacttggtaaccagtacaagacgtaccaggacacgccttacgaggctgctactatttacgnggtacatccgtaacccggaagtccccggggtccctacgacctgttacgaaggttcggactacggggtcgggtactacggggacctaggttactttaccacgtccttacacctagtcacgaccctaggcccgttagacccgtgggtaccttaggaaaacggtacgttggtacgggttaactttaaggtttttaagtttaaacgttacggtaaacctaaagttaaactttaatttaacgtttaacgttaaccgtttacgggttacgggtaaaccggttttccgggaaaccggtaaaacggggacccgttaaaaggggtcggtaaactacgttaagaaacggacgtaaaacggtggtacggaccttacggaaccc

SEQ ID NO: 431368 - DNA, 616 bp, Homo sapiens
  misc_feature: GZ8MTXP02ID2JF.19.71.G05.1.454.CMB.2.raw
  modified_base (187)..(187): a, c, t, g, unknown or other
  modified_base (250)..(250): a, c, t, g, unknown or other
  modified_base (446)..(446): a, c, t, g, unknown or other
  modified_base (488)..(488): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtntctcgtgggcgagccgggccaccgatcaactcgacaacgtccagccactaacttctttttaanactaacgttacccaaactaaattacgaaaacttacttaagtcgttacggtaccagacagacgaccaggacacgcctcgtaggctacgcttctacttttacgcgggtacacgtaccgtaacccggggacgtccggggtccccctcggaccgtattcgaggtcggcgaggtcggggtactgggggactagtactttcncctcctcacctactacagccagcctcgacgtagcgtagaagntcggtagtattagttattattacgtaacaataattatttattactacgttgtacggtacgttacggaccgtaaaggaccgtaggtacggtaatagtaaccggaagacgtaactggtacgacgtacgac

SEQ ID NO: 431369 - DNA, 668 bp, Homo sapiens
  misc_feature: GZ8MTXP02FFNA9.19.71.G05.1.454.CMB.2.raw
  modified_base (224)..(224): a, c, t, g, unknown or other
  modified_base (601)..(601): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctntcgctcacctgtcgccatcgtcggggacagagtcgctagcgacagtgttgcttggcacgtgggtcaggcacgtccccatcgagaggtctagagtggctaggggaagacagtactttcattcgtccaaacgacgtaggaaataactaaaatttagtacgaccaaaccctaagttccgttaggttagaaggtacgtaccggtaaccgttaggtaacgaaaacttaccgaaaaccggttacggaaaccaacgaaacgtaaccgaaaacggaaccctaacggtttaccctacccccgttgaccgaacggtcctacggtaaccccttcgttacggttccggaaacccgttaccccgggaacgggaaccgtaaccgggggttnttaaacgttaacgtttaaccgttaggttaacgggtaaacggacccgggaacccccaagttaaaccgg

SEQ ID NO: 431370 - DNA, 644 bp, Homo sapiens
  misc_feature: GZ8MTXP02G6GXR.19.71.G05.1.454.CMB.2.raw
  modified_base (400)..(400): a, c, t, g, unknown or other
  modified_base (587)..(587): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctccacctgtcgccatcgtaccggggacagagtcgctacgcgactaggtgttgcgttggcacgtgggtcacggcacgtccccagtcgagaggtctaggagtggacgtaggggaagactattagtttacagttcgtaccaacgtacggtaggaaaacttaacaaaagtttanacgactaacctattcgtagttagaacgtagttacgacgttacgaaactaaactaccgaaaacggttacaaacacctaagttaaccgaaaacgtaaaccttaacggttccctaccctaggacacgtacctaacgtcccttagtcggttacgaacccggtacccggaaagggtaccggtaacggggttnttaaccgttaagttaccgtgggtaacggaaacggtaccgaccccgtaagtaaaccgg

SEQ ID NO: 431371 - DNA, 576 bp, Homo sapiens
  misc_feature: GZ8MTXP02GGWL0.19.71.G05.1.454.CMB.2.raw
  modified_base (227)..(227): a, c, t, g, unknown or other
  modified_base (236)..(236): a, c, t, g, unknown or other
  modified_base (278)..(278): a, c, t, g, unknown or other
  modified_base (300)..(300): a, c, t, g, unknown or other
  modified_base (307)..(307): a, c, t, g, unknown or other
  modified_base (358)..(358): a, c, t, g, unknown or other
  modified_base (397)..(397): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccanaatctttanacagttccaacaatgaaaactacttagcttggacagcaaganaccagacagcctctagctgctnatttacnggctatccgtacccgggaatccggggtcccctgacccgtattcagtcggcncggcgggtctgggacagtatttcgactctcaccatcacncacgctgacgagactagaagtagtgtgtataagtttattagtacgtaactaaactaattaattattaacgttacgttacggttacggtaccgttaccggaacggggggtaaacgtaaccgtaagggtaacgtaagtaacgtaagtaacgtaaccgtacgtacggtacgtacgtacgacc

SEQ ID NO: 431372 - DNA, 714 bp, Homo sapiens
  misc_feature: GZ8MTXP02G9Q5B.19.71.G05.1.454.CMB.2.raw
  modified_base (225)..(225): a, c, t, g, unknown or other
  modified_base (237)..(237): a, c, t, g, unknown or other
  modified_base (474)..(474): a, c, t, g, unknown or other
  modified_base (710)..(710): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtcgaacgccctcgcacgaccctntcgctcactgcnccatccgtccggggacagacgtcgacgtacgcgactaggttcgttcgcgtttggcctacgttggggtacagggcctacgtccccaagtcggagtacggtactaaggtggtcggaccggtaggggaaacgtactagttacgtttacaacgttccgtacccgaaacgtcgggttaaacggaaacttaaaaccgtaaaaggtttctaccggaactaacccttaaggttcctaggggttanaaaggtacgttaccggaacttaggaaaaccctattaaccgtaaaacgttactaaaccgaacgtaacgttaaccgggaaaacttaaacccttacgggtttaccccacccgggtacgaaccgtacgttaccgtaccgtaccgttacggtaccggaccgtacccgtaccggaacggttaccggtacgttacttaacgttaacgtacggtacggtaacggaacccgtaccgaaccgttanaacg

SEQ ID NO: 431373 - DNA, 727 bp, Homo sapiens
  misc_feature: GZ8MTXP02G6XF4.19.71.G05.1.454.CMB.2.raw
  modified_base (248)..(248): a, c, t, g, unknown or other
  modified_base (264)..(264): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtcgtctcgtgggcgacggccggccaccatacaactgacaacgtcagaccactaattctttanactacgttacccaaanaatacgtaaaacctcttaagtcttacggacagcaagacgacaacggacacgccgttacgtaggcctgaccttacgtacgttttaacgcgggacttacgtaccccggtaaaccccggggtacgttccccggggtacccctagggaccccttaagttccggaggttacggccgttacgggggccgggttacggtagggacctaggttaactttccaactcccttacaacccgtataccgacggtaccacgttccgacgacccgtagggacttaacgggaaagtcgttagggtaccggtttaatttaagtttaagttaccgtttacaaaccttaaattaaacttaagttttacttacgttacggttaacgtttcggtaccgttacggaaccgtaaacggtaaccgtaaggttagacgttaaagtaacgaacggtaacgtacggttacgtacggtacctacgtaacc

SEQ ID NO: 431374 - DNA, 549 bp, Homo sapiens
  misc_feature: GZ8MTXP02GDR66.19.71.G05.1.454.CMB.2.raw
  modified_base (226)..(226): a, c, t, g, unknown or other
  modified_base (234)..(234): a, c, t, g, unknown or other
  modified_base (243)..(243): a, c, t, g, unknown or other
  modified_base (247)..(247): a, c, t, g, unknown or other
  modified_base (253)..(253): a, c, t, g, unknown or other
  modified_base (256)..(256): a, c, t, g, unknown or other
  modified_base (264)..(265): a, c, t, g, unknown or other
  modified_base (299)..(299): a, c, t, g, unknown or other
  modified_base (353)..(353): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccacatcaactgcaagtccagccanatctttanacatacaanatanaaactntanctagacannagacacagacagcctcagctgctactatttacgnggactactaccgtaaccgggagtcccgggtccctagaccgtatcgagtcgacgnggcggtagtagggacagtacttcactctacacatcagcacgcctagacgagactagaagtagtgtacggtattagtttattagtacgtaactaaataattatttaattacttacgttacggtacggtacgttacggaccgtaaagggacgtaaggtagtatacgtaacgaacgaacgtacgtggtacgactacgac

SEQ ID NO: 431375 - DNA, 699 bp, Homo sapiens
  misc_feature: GZ8MTXP02HUOGM.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccagggactggtgaacgccctcgcacgaccctctccgctacacctgtcgccagtccgtaccggggacaggacgtcgctacggcgacaggttgttgcgttggctacgtgggtcaggccacgtccccagtcgaggaggtactaggagtggcgtacggggaacgactattactttacacttacgtaccaaacgtacggtaagtaaacgttaaactaaaagtttaactacggtacctaacctacgtttcgtagggtttaggaaagggttacgtacggtaactaaggaacctaaaacgtacgaaaaccggttaagtaaccaacgtaacgtaaacgtaaaccgtaaacccgttacgttaccccgtacccgttagacccgtacggtaccgttaccgtaaacccgtcgttacggtaccgacccggttacccggacggtaaccggtacgggttagtaacgttaagttaccggagggttacggaaaccggtacccggtaccccgtaagtaaaccgg

SEQ ID NO: 431376 - DNA, 657 bp, Homo sapiens
  misc_feature: GZ8MTXP02IDH2D.19.71.G05.1.454.CMB.2.raw
  modified_base (238)..(238): a, c, t, g, unknown or other
  modified_base (395)..(395): a, c, t, g, unknown or other
  modified_base (427)..(427): a, c, t, g, unknown or other
  modified_base (608)..(608): a, c, t, g, unknown or other
  modified_base (634)..(634): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctcgggcctccacaaggtgtcctgtcacaagtacagctgcagcagtcaggtccaggactggtgaacgccctcgcacgaccctctcgctccacctgtcgcctacgtccggtaccgggganaaggtacgtcgcgtacggcgacgtagttggtgtcgttggcacggtgggtcaggccacgcccctagtcggaggtaggtcgtaaggcggtggacggtaggggaagtactaatttatttcaacgtcgaaacctaagaacggtaggaaacctaataaaatntacgacactatcgtgttagagacgtagactanaacgaataccgaaagttacgaacacgtaagtacgaaactaaccgtagtaccccttccgagaccgtacgactcgttaactcgtacggtaccgtaaccgacccgggtaagaacgtttacggggactttaaggtacctaggtcgtaaaggggactacccgaaccgtaggtaaacaccggttacnccgtaaccccgtacgttcgttaccgnggtttcgacgttacgttaacggg

SEQ ID NO: 431377 - DNA, 605 bp, Homo sapiens
  misc_feature: GZ8MTXP02HRXL7.19.71.G05.1.454.CMB.2.raw
  modified_base (318)..(318): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctccacctgtcgccatcgtccggggacagagtcgctagcgacagtgttgcgttggcacgtgggtcaggcacgtccccatcgagaggtctagngtggcgtggggaaggactattatttcattcgtacctaaacgacgtaggaaattaacctaaaatttactcgacctaaccctattcttaggttagtagtaggttcgtaacgttagaaacaaacgttacaaacgttaacgaaactaactaagtaaccgaaagtaaaccctacgttaccctacccgtgtccaacggtactcgtacccttgtcgtacgacccgtaccggacggaccgtacggtcgttaagtaagttcgtaggtacggaacgtaccgaccccgtagtaaaccg

SEQ ID NO: 431378 - DNA, 777 bp, Homo sapiens
  misc_feature: GZ8MTXP02JV7F7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccagaaggtgtcctgtcacaagtacagctgcagcagtcaggtccaggactggtcgaacgccctcggccacgaccctctcgcctcacctgtcgcctagtccggtaccggggacaggacgtccgacgtacggaccgacgtaggttgttacgccgttggcctacggttgggtacacggtaccaccgtccccgagttcccgggaaggtacggtacgttaaggagggttcgggaccggttaagggggaaacgtactaagtttactttacgaacgttccggttaacccgaaacggtaacggttaacggggtaaaaacttaaaccgttaaaaatttaccgtacgggtaccctaaaacggttcgttacgttagggttaggtaacggtacgtaaccgaacgttacgaaactaaacgtaaccgaaacggttaaacgaacaaccgaagttaaccggaaacgtaaaccgttaccggtttacccttacccggacgtactaccgggttactaccgtaccgtttacgtaacggttccggtaccccgtaacccgggtaacggtaaaccgtacggggttaacttaacgttaacgttacggtacggtaacggtaaccggacccggaaccccttaaggtaacccg

SEQ ID NO: 431379 - DNA, 624 bp, Homo sapiens
  misc_feature: GZ8MTXP02HKKQM.19.71.G05.1.454.CMB.2.raw
  modified_base (238)..(238): a, c, t, g, unknown or other
  modified_base (260)..(260): a, c, t, g, unknown or other
  modified_base (350)..(350): a, c, t, g, unknown or other
  modified_base (387)..(387): a, c, t, g, unknown or other
  modified_base (498)..(498): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtagaacgccctcgcacgacccctctcgctccactgtcnccatcgtccgggacagagtcgntagcgacagtgttgcttggcacgtggggtcaggccacgtccccagtccgaggtaggtctagaggtggacgtagggaacgactattacttnatacgtaccacgacggtaagtaaactaactaaattangtaccaacctattcgttggttacggagtacgtacgacgtagaaaccgaattacgaaacggtacaaccgaactacgttaacgaaacgtaaccgtacgtttccctacccgtanaccgtacgaccgtactaccgtcgtacgtaccgtacccgtaccggaaacggtaccgtaacggggttacttacgttaacgttccggtagggtacggaaaccggcccggtacccctaagttacgaaccg

SEQ ID NO: 431380 - DNA, 663 bp, Homo sapiens
  misc_feature: GZ8MTXP02F9XJS.19.71.G05.1.454.CMB.2.raw
  modified_base (240)..(240): a, c, t, g, unknown or other
  modified_base (317)..(317): a, c, t, g, unknown or other
  modified_base (376)..(376): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaattcttttanacagttccaaacaatgaaaactcttagcttaggaccagcagagaccaggacagcctactaggctgctctatttacgngggcatccgtaacccgggaatcccggggtacccctagacccgtattccgaggtcggacnggggtccgggtctgggggacctaggtaactttccaacttctacaaccctatccaagcacgccctggacccagggacctaggaaaacgtgtggtacggtacttaagggttttaacttagttacgttacaaaacgttaatttaatttaatttaacgttaccgtttacgggttaacgggtaccgttttaccgggaacccgtaaaagggggtaaccctaaaggggttaggtaaccttaaaggttccgaaaggtaacccgtaaacgttggtaacgggacttacggaaacccg

SEQ ID NO: 431381 - DNA, 499 bp, Homo sapiens
  misc_feature: GZ8MTXP02FLMEI.19.71.G05.1.454.CMB.2.raw
  modified_base (220)..(220): a, c, t, g, unknown or other
  modified_base (458)..(458): a, c, t, g, unknown or other
  modified_base (469)..(469): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctntcgctcacctgtgccatctccggggacagagtcgctagcgacagtgtgcttggcactgggtcaggcagtccccatcgagaggtctagagtggctggggaacgacatatttcatgtaccacacgtggaaatacaaattatgacaccatctgttgagagtcgactgacaagtcaagtagacacatcgaagaaccagttcaccctgcagctgacctctcgtcgactcccgagacacgggtntatattaacgnggtacggaacgacggtccccaagtacgaac

SEQ ID NO: 431382 - DNA, 596 bp, Homo sapiens
  misc_feature: GZ8MTXP02FFPLW.19.71.G05.1.454.CMB.2.raw
  modified_base (248)..(248): a, c, t, g, unknown or other
  modified_base (307)..(307): a, c, t, g, unknown or other
  modified_base (334)..(334): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccgatccgaacgtgacaagtccagccactaattcttttanactagttacccaaactaatacgaaaacttctagcttaggaccagcagacgaccaggacngccctaccgaggctgctctatttacgngggacctagtaccgtaaccccggggtaatccccccggggtcccctagacccgtaatttcgaggttcggccagggtccgggtgtacggggactaggtactttccacttcacaccataccgagcacgcacgcgagagagagagtagtgtatagtttattagtagtactaatatattattattacgttacgtacggtacgttaccggtacgaacggaccgtaacggtagtagtaagtacgaagacgtacgtagtacggtacgtcg

SEQ ID NO: 431383 - DNA, 644 bp, Homo sapiens
  misc_feature: GZ8MTXP02IARCH.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatcgtccggggacagagtcgctagcgacagtgttgcttggctacgtgggtcaggccacgtccccagtcggagtaggtcgtaggaggtggcgtaggggaaaggtactattatttcgaagttcgtacccgaaacgtacggtaggtaaacttaacgtaaatttagcgaacctacacttcgtagttagaagtacgtacgtaactacgaactaagtacaaaacgttacgaaccaacgtacgtacgaaaacgtaaccgtacgttacctacccgtagacctacgtaccgtacgtaacccttcgtacggtaccgtaccgtacccgggaaacggtaccggtaacgggttgttaaacgttaacgtttaaccgagggttacggaaacggcccggtaccccgtaagtaaacccg

SEQ ID NO: 431384 - DNA, 647 bp, Homo sapiens
  misc_feature: GZ8MTXP02IA2VR.19.71.G05.1.454.CMB.2.raw
  modified_base (153)..(153): a, c, t, g, unknown or other
  modified_base (224)..(224): a, c, t, g, unknown or other
  modified_base (277)..(277): a, c, t, g, unknown or other
  modified_base (481)..(481): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccanaaggtgccctgtcacaagtacagctgcagcagtcaggtccaggactggtgaacgccctgcaacgtcccctntcgctcacctgtgcccatcgtccgggggacacgacggtcgctacggcgaacgngttgttgccgtttggcctaccgttgggacacgggcctacgtcccccgaatccggagtaacggtctaaggcgttgggactagggggaatacgtatatttcgattcgggtaccaacgtaagttacggaaattacaaaatttgcacctaaactagttcgtagttacggagtacgtacgacgtagaaactaacgtaacgtaaacgtanaaccaacgtaacgtaacgtaaacgtaaccgttacgttaccctcgtacgacggtacgacctacggactttcggtacgtaccgtacccgtacgggacgtacggtaacggttataacgttaacgttacggtaacggtaccggtaaaccggacccgaaccgtaacgaacg

SEQ ID NO: 431385 - DNA, 672 bp, Homo sapiens
  misc_feature: GZ8MTXP02H8PUZ.19.71.G05.1.454.CMB.2.raw
  modified_base (628)..(628): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctcttcctcttcttcctgccgtgctgggcctccacaaggtgtcctgtcacaagtacagctgcagcagtcaggtccaggactggtagaacgccctcgccacgtacccctctcgcctcactgtcgccagtccgtccggggacagacgtcgctacgcgacgtagtgttcgtcgttggctacggtcgggtacacggtccgacgtacccccgagtaccggaaggtacggtccgtaaaggtacggtcggggtacgtacggggaaaacgtaccgtaatttacgttttacacgttcgtacccgaaacgtaacggttaggtaaaacttaacgtaaaaacttacgtacgaccctaacctagttcttaggttagagttacgtacgacgtacgaactaagtacgaaacgtaagaacaacgtaagtaaccgaaagtaccctacggtttaccacccgtacgacgacgtccgttacgtaccccttgtaccgtacggacccgtaccggaaacgtccgtaacgggttntaacttaacgttcgaggtacgaacgtcccgaccctaagtaaccg

SEQ ID NO: 431386 - DNA, 689 bp, Homo sapiens
  misc_feature: GZ8MTXP02JT9S1.19.71.G05.1.454.CMB.2.raw
  modified_base (223)..(223): a, c, t, g, unknown or other
  modified_base (277)..(277): a, c, t, g, unknown or other
  modified_base (341)..(341): a, c, t, g, unknown or other
  modified_base (524)..(524): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcacgccctcncgctcacctgtcgccagtccgtccggggacaagcgtccgctaacgccgtaacgngttgttcgcgtttggcgtacgtgggtcacggccgacgtccccgagtccgaggtacggtctaagnggtcggagtacggggaagatattatttcgaagttcgtacccgaagacgtacggtaaaacttaacgtaaagtttcagaccctaaactcgttacgttagttacggagtacgttacgaacgtacgaactaacgtaacctaaacggacgaacctaaactaacgtaaccggaaaaccgtaaacccgtntttacccccggtaacccgtcgaccgtaccgtaccgtaccgtacccgttcggtacgtacccggtacccggtaccgggaaacggtaccggttaacggttaacgtttaacgtttaacggttaacggtacggtaacggtaaccggaccccggtaaaccgtaaggtaccg

SEQ ID NO: 431387 - DNA, 663 bp, Homo sapiens
  misc_feature: GZ8MTXP02FGCIA.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgcgccatcgtccggggacagagtcgctagcgacagtgttgcttggcacgtgggtcaggcacgtccccagtcgagaggtctagagtcggcgtaggggaagactattatttcatcgtaccaaacgacggtaggaaattaacgaaaatttatacgacctaaccctagttaccgttaggttacgaacgtaggaccgtagttacggaactaaacgttacgaaaccggtagaaacctacgaacgttaaccgggaaaacgtaaccgtaaccgtttccctaccccgtagaccgtaacgccgtttaccgaaaccccttcgtacggtacccgtaacccgtacccgggacggtaaacccggtacgggggttctttaaaagtaacgtttaacgttagggtaaccgggaacgaccccggggtaacccccaagtaaacccgg

SEQ ID NO: 431388 - DNA, 634 bp, Homo sapiens
  misc_feature: GZ8MTXP02IK4ZM.19.71.G05.1.454.CMB.2.raw
  modified_base (298)..(298): a, c, t, g, unknown or other
  modified_base (387)..(387): a, c, t, g, unknown or other
  modified_base (406)..(406): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctccacctgtcgccatccgtccggggacaggagtcgctaggcgacagtgtgctggcactgggtcaggcacgtccccagtccgagaggtctaggngtggcgtagggaagactattatttacagttgacctaaagacggtaggtaaactaactaaaattgtacgacaacctaattcgtaggttanaaggtacgtacaacgtaanaactaataacgaaacgtacgacaactagtaacgaaacgtaaaccctacgttacccgtacctacgacctacgtctacgtaccttcgttacgaccgtacccgtacccggaaggtaccgtacgggttataacgttaacgtacggtacggtaacggtaaccggacccgaacccgtaagtaaccgaactacgtccgaacccgtaccgttccgtcgtacgtcgtactacgtagg

SEQ ID NO: 431389 - DNA, 653 bp, Homo sapiens
  misc_feature: GZ8MTXP02GFE8E.19.71.G05.1.454.CMB.2.raw
  modified_base (244)..(244): a, c, t, g, unknown or other
  modified_base (335)..(335): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatcgacccagtctccagctcctggctgtgtctcgtgggcgagccgggccaccgatcgaacgtgacaagtccagccaactaattcttttaanacgacttacccaaataagtactaaaactacttagtcttaggaccagcaagacgaaccaggacagcctcgtaggctgcctactatttaccgngggactacgttaccgtaaaccggggagtaccccggggtcctccgggtaaacccgtcttacgtaggtcggcgacgggtccgggtcgtacgggaactacgttcttaccacttcacctactacgtacgacgacgacgtcctacgtacgtacgtacgtacgagtagtagtacgtacgttagtttagttagttagttaacgtaaacgtaattaattaacttagttacgttacgtacggtacggtacggtacggtaacggtaacggtacggtagtacgtacgtacgtaacgtaacgacgtacggtacgtacgtacgtacgtacg

SEQ ID NO: 431390 - DNA, 698 bp, Homo sapiens
  misc_feature: GZ8MTXP02IUPRW.19.71.G05.1.454.CMB.2.raw
  modified_base (487)..(487): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcacgaccctctcgctcacctgtcgccatctccggggacagagtcgctagcgacagtgttgcgttggctacgtggtcaggcacgtccccgatcgagagtctagagtgggctaggggaaggactagttaacttcagttcgttacccgaaactacgggtaggtaaaattaaaccgtaaaatttacgttagacctaaaccctattaccgtaggtttacggaaagtacggttaccgaacgtttacggaaaacgtaaacttaccgtaaaaaccgggttanaaacccggactaaagttaaccgggaaaaccggttaaacccctaagggtttcccttaacccccgttagaacccggtattaaccgtccggtaacccttccgtaggtttacccggaccttaccggggaacgtacccggtaggggttacttaaagttaaccgtttaacgtaggttacgggaaaaccggtccgttacccccgaagtttaaacccgg

SEQ ID NO: 431391 - DNA, 537 bp, Homo sapiens
  misc_feature: GZ8MTXP02HUIVZ.19.71.G05.1.454.CMB.2.raw
  modified_base (267)..(267): a, c, t, g, unknown or other
  modified_base (351)..(351): a, c, t, g, unknown or other
  modified_base (363)..(363): a, c, t, g, unknown or other
  modified_base (465)..(465): a, c, t, g, unknown or other
  modified_base (532)..(532): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcctccggggacagagtcgctagcgacngtgttgctttggcacgtgggtcaggcacgtccccatcgagaggtctagaggtggcgtggggaagacctatatttcatgtccaanacgtagaataanaacttatacgcacctatctgttagagtagtacgactagaactataccgaagtagaccatatcgaaagaaccctagtccctcctagccagtctacgacccttntagcgacctcccggaggacctacgggtatattaacgttcgtaggtacggtaacggaccgcccctaanaacgg

SEQ ID NO: 431392 - DNA, 690 bp, Homo sapiens
  misc_feature: GZ8MTXP02HTDAS.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctctcgctcacctgtcgccatccgtccggggacaggacgtcgctaggccgacgaggttcgttgctttggctacgtgggtacaggcacgtccccagtcgagaggtctaggacgtggcgtaggggaaagacgtattagtttcacgttcgtcccaaacgtacggttaaggtaaaacttaaacctaaaatttatacggacctaacctaaacgtttcgttaaggtttacggaagtacgttaccggtaacttaggaaacctaaacgtaccgaaacgttaacgactaacgtaacgttaacgggaaaactaacccgtaagtttcccctaccgttaggacctaaacgtcgttacgaacccctttcgtacgtttaccgaaacccggttcccggaaacgggtaacccgttaccggggttaattaacgttaacgtttacgacgggttaacggaaacgtacccggtaccccttaagtaaccg

SEQ ID NO: 431393 - DNA, 662 bp, Homo sapiens
  misc_feature: GZ8MTXP02JUW35.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggctggtagaacgccctcgacgacgacccctctccgacctccacctggtcgcctacgtccgtaccggggacaggacgtcgctagaccgacgtagtgttgcgttggactacgtgggtcacggctacgtcccagtcggagtggtctaggaggtggcggtaggggaaccgtactattattactactcggtaccacgtacgggtaaggaaacttaacgtaaattcgtacgacctaccgtagtttacgtaggttacggaacggtagtacccgtaaacgtagtaaaccctacgttaaccgaaacgttaaacgacctaaacgtacgtaaaccgaaaccgtaaccgtacggttcccacccgtagcgtaacgtcctacgtccttacgttcggtaccgtccgtaacccgggaacggtacgtacgggttataccgttataacggcgtaagggaacctccggaccctaaggaccgaacg

SEQ ID NO: 431394 - DNA, 747 bp, Homo sapiens
  misc_feature: GZ8MTXP02I16CQ.19.71.G05.1.454.CMB.2.raw
  modified_base (260)..(260): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtcgaacgccctcgacacgtaccctctcgcctcacctgtcgccagtccgtccgggganacgacgtcgctacggcgacgtaggtcgttcgtcgtttggactacgtcgggtcgacggccaccgtccccagtcggagtaggtacgtagcggtggtcgtaggggaaagtactagttacgtttcgattacgtaccgaaacgtaacggtaaggtaaaacttaaacgttaaaacgtttagtacgtaaacccgtaccgtttaaacgtttccggttacgggtttaagggtaaaccggtaacggtttacccgaaaacccggtttaggaaaaacccttaaacgtaaccggtaaaaaaccggttaaccggaaaccttaaacggtaacgttaaacccggtaaaacgtaaacccgtaaccgggtttccctaccccgttaggaccctaggtacccttacgacccctttggtaaccgtaccgtacccgtaaccggtaacggtacgtaaccggttgtaacttaagtacgtacggacggtaacggtaccgacccaagtaaccg

SEQ ID NO: 431395 - DNA, 557 bp, Homo sapiens
  misc_feature: GZ8MTXP02HCB7I.19.71.G05.1.454.CMB.2.raw
  modified_base (338)..(338): a, c, t, g, unknown or other
  modified_base (355)..(355): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctgcacgaccctctcgctcacctgtcgccatcgtccggggacagagtcgctagcgacagtgtgcttgctacgtgggtcaggcagtccccatcgagaggtcagagtggcgtggaacgcatattcatcgacanacgtagaatacaaattngacactatcgtagttagagtacgtacgtactagaaactaagttaccgaaacggttaacgaactaaccgaacgttaccgaaaacgtaaccgtacgttaccctaacccgttgactaacggtctacgtacctcgtacgtcgaccgtaccggaggtacgtacgggtatagtactaagtacgtaggaacgacgtacccagtacgaac

SEQ ID NO: 431396 - DNA, 728 bp, Homo sapiens
  misc_feature: GZ8MTXP02HCILJ.19.71.G05.1.454.CMB.2.raw
tcagtactctcgtgcacgaccggtgctcgattttagtgtcgtcgcaagagagagggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtccgctaggcgactaggtgttcgcgttggcacgtggtcgaggcctacgtccccagtcggaggtacggtcgtaggaggtcggacggtagggaaacgtactaattacgtttacagtcggtaccaacgtacggttaggaaaactaacctaaattacacgactaacttacgttcgtagttacggagtacgtacgtaacgagaaactaagtaccaaacgttaacgaacctaacgaacgttaacggaaaacggttacctaaccgtttcccgtaaccgtcgaccgtaccggttaccgtaccgttaacccttcggttacggtacccgtacccgtaccccggggtaggtaacccggttacggggtttaccttaaagtttacgttaacccggttaggggtaccgggaaaacggtccccgggtaacccctaaaggttccgaaccgttacgtaccgtaaccccgtaccgttctacggttcgtacgggtactacgtttacggg

SEQ ID NO: 431397 - DNA, 738 bp, Homo sapiens
  misc_feature: GZ8MTXP02H1NYG.19.71.G05.1.454.CMB.2.raw
  modified_base (248)..(248): a, c, t, g, unknown or other
  modified_base (262)..(262): a, c, t, g, unknown or other
  modified_base (341)..(341): a, c, t, g, unknown or other
  modified_base (580)..(580): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtggcgaggccggccaccatcaactgacaacgtccagaccaactaattctttanacacgttaccaaanaataacgaaactactagcgttacggtaccagcaagacgaccgaagacacgcctaccgaggctagcctactagtttacgngggactacgtacccggtaacccgggaacgtcccggggtccccctacgaaccgtattccgaggtcggcgagggggtccgggtacgtagggtactaacgtttcttacccgtacctccctacccaaaccgttacgccgtaacgacccgtacgtcccgtggaacccgagggtctaagggaaacgtggttcgggaggttaactttaaggtttataagtttacgtaaacctaaaattaaaatttntttaaaactttaacgtttacggttaaccgggttacggggttaaaccccggtttaccggggaaaacccgtaaaaacgggggtaccgttaaaagggggtactaaacggttaactaaccggaaaaggtaaacgtacggttagtacggacggtacgaacccg

SEQ ID NO: 431398 - DNA, 666 bp, Homo sapiens
  misc_feature: GZ8MTXP02H69UA.19.71.G05.1.454.CMB.2.raw
  modified_base (400)..(400): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcagtccaggactggtgaacgccctgcacgaccctctcgctcaccctgtcgccctagtccgtccggggacaggacgtcgctacgcgactagtgtgcgttggctacgtgggtcaggcacgtccccagtcgagtaggtctagaggtggcgtaggggaaggactatagtttcagttcgtaccaaacgtaacgtacgtaaaactaactaaagtttaanacactactattcgtagtagagtacgtacgtaactacgaactacgaacgtaaacgtacgaaaccaacgtaaacgtaaccggaaaaccgtaaaccgttacgttacccgtacccgtagaccgtaacgtacctaccgtaacccttacgtaccggtacccgtaccccgtaacccgggaacggtaaccgggttacgggttaacttaaacgttaacggtttaccggtaacgggtaacgggaaacccggtaccccgtaacccgtaagtaacccg

SEQ ID NO: 431399 - DNA, 789 bp, Homo sapiens
  misc_feature: GZ8MTXP02JMT6O.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtcgaacgccctcgccacgaccctctcgcctcaccgtgtcgcctacgtccgtccggggacaggacgtccgacgtacggcgacgtaggttcgttcgtcgtttggcctacggtcgggtacacggtccacgtccccaagtcggaggtaggtctagaggtggtcgtaggggacgtactagttacttcgagttcgtaccaacgtacggtaaggtaaactaagtaaatttacgtacgtaaccctaccgttattccggttaggttacgaaacggtacgttacccggaacttacgaaacctaaaacgttacgaaaaccggttacgaaacctaaccgtaacgtaaacccggtaaaacgtaaaccccgttacgtttaccccgtaccccgttaacgaccgtaaaccggtttccgttaaaacccggttaacccgttaacgggtttaccgggttaaacccggtaaaccccggttaccccggggaaaaggggtaaccccggttaacgggggtttaaactttaacgttaacggtttaacggttacggggttaaaaccggggaaaaccgtaccccggggttaaccccaaagtttaaacccgg

SEQ ID NO: 431400 - DNA, 574 bp, Homo sapiens
  misc_feature: GZ8MTXP02JXEDZ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggcgtcctgtcacaagtacagctgcagcagtccaggtccaggactggtgaagcccctgcagaccctctcgctcacctgtgcccatcgtccggggacagagtcgctagcgacagtgttgctttggcactgggtcacggcacgttccccagtcgtagaggtctagagtcggctggggaagactattagtttcatgtccaaacacgttaggaatacaaattatcgacaccatctgttagagtatcgactgaactaataccaaagtagaaccacgtaaatacgaacgtaacctacgttccctaccgtagacgtacgtacctacgaccttacgtacgtcgtacccgtacccggaacggaccgtacggtattaacgtaacgttacgtacggtacggtaaccggacccgtacccgtaagtaacg

SEQ ID NO: 431401 - DNA, 731 bp, Homo sapiens
  misc_feature: GZ8MTXP02G5WJ5.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccactaaggtgtcctgtcacaagtacagctgcagcagtcaggtccaggactggtgaacgccctcgcacgaccctctcgctcacctgtcgccatccgtccggggacagtacgtcgctagcgacagttgttgcgttggcacgtgggtcaggccacgtccccagtcggagtggtctagaggtggacggttaggggaacgtactaagttactttcgagttacgtaacccaacggtacggtaaggtaaacttaaacgtaaagtttacgtacgacccgtaaacctgtttaccgtaaggttacggaacggtaacggttaccgtaacgtaacggtaaacctaaaacgttacccgtaaaacggttaaacgaacccctaaaagtaacggttaaaccggaaaaccgtaacccgttacggtttacccctcccgtaggaaccgtaacgtcgtaccggtaccttcgtacggtaccgtaacccggtccgggtaaaggtacccggttacggggttaacttacgtttaaaccgttaaccgggttagggaaaccgggtaaaccgtaccccgggtaccccttaaaagtaacggtaaacccg

SEQ ID NO: 431402 - DNA, 540 bp, Homo sapiens
  misc_feature: GZ8MTXP02FHUHL.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtgccatcgtccggggacagagtcgctagcgacagtgttgcttggcacgtgggtcaggcagtccccatcgagaggtctaggagtggctaggggaagacagtatttcattgtccaaacgacgtaggaataacaaattatgacaccatcgtgttagagagtcgaactagacaaatcaaacgtagaacacatacgaaacgaacctacgttacctacccgtgacagctcgacccttctcgtcgaccgtaccgacggacgtacgggtgtaactaagttacgtagtacggaacgtacggaccccagtaacg

SEQ ID NO: 431403 - DNA, 636 bp, Homo sapiens
  misc_feature: GZ8MTXP02JHPQW.19.71.G05.1.454.CMB.2.raw
  modified_base (394)..(394): a, c, t, g, unknown or other
  modified_base (503)..(503): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcacggcacgtccccagtcgagaggtctagagtggcgtaggggaacgtactattactttcgagttcgtacccaaacgtacggtaggaaaacttaaacgtaaaatttanacggaccctaacctaattcgtgttacggaagtacgtcgaacttagaaaccaaataccgaaacgttagaacaacagtaaccgaagtaaaccctacgttccctacccgtanacggatccgtacgacccttcgtacggtacgaccccgtaccggaacggtaaccgtaccggggttattaaacgttaacgttaccggttaggaaacggggaaaaccggtacccggaacccccgttaagtaaacccg

SEQ ID NO: 431404 - DNA, 644 bp, Homo sapiens
  misc_feature: GZ8MTXP02G22KE.19.71.G05.1.454.CMB.2.raw
  modified_base (241)..(241): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactcccgtggctgtgtctcgtgggcgagccgggccacgatacgaactgacaagtcagcacattctttanactagttacaacaatacaaactctagtctaggtaccagacagagaccaggacacgtccctacgtggcctgctactacgtttacgaggctaactacccgtaacccggggtaacgtccccccggggtaccctacgaacccgtagtttcccgaaggttcggaccggacggggtccgggttaccgtagggggacctaaggttaactttccaacttcttacaccgatcacgtacagtcccgtgacgacgagtagagtagtgtaggtatagttattagttagtactaataattaattattaattacgttacggttacggtacggttaccggttaccggaaacggtaaccgtaacggtacggtaagtaacgtaacgttaacgaaccgtacgtacggtaggtcttaaccgg

SEQ ID NO: 431405 - DNA, 698 bp, Homo sapiens
  misc_feature: GZ8MTXP02HS608.19.71.G05.1.454.CMB.2.raw
  modified_base (254)..(254): a, c, t, g, unknown or other
  modified_base (337)..(337): a, c, t, g, unknown or other
  modified_base (376)..(376): a, c, t, g, unknown or other
  modified_base (389)..(389): a, c, t, g, unknown or other
  modified_base (401)..(401): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgagccgggccaccatacaactgacaacgtccacgccaactaatttctttaanactacgttaccaaactaatagaaaactctagtcttaggaccagcagacgaccaggacacgcctcgagctgctcgtatttacgnggctagtccgtacccgggagtcccggggtcccacgactnttcgaggtcgacncggggtcgggtntacgggactagtacctttacgaccctctaccaaccctataccgacgcgtacgccgtagacgacgtacgtaaggaacgttgttacggttacgtttagtttaacgttttaagttacgttaacgtaaacttaaatttaaatttaagtttaaactttacgtttaaccggttacgggttaccgggttaaaccggttaccgggtaaaccggaaaacgggggttaaccgtaacggggttaacgtaacgttaacggtaacgtaaacggtaaacgtacggttacggtaccggtaccgttacgaccg

SEQ ID NO: 431406 - DNA, 571 bp, Homo sapiens
  misc_feature: GZ8MTXP02G5PNP.19.71.G05.1.454.CMB.2.raw
  modified_base (222)..(222): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctntcgctcacctgtcgccatccgtccggggacagacgtcgctagcgacagtgtgctggcacgtgggtcaggtcacgtccccatcgagtggtctagagtggactaggggaacgacattactttcatcgtaccacgtacggtaggaaatacaaattatgaccactatactgtagagtagtacgactagaactaagtacgaaacgtaacgaacaacgactaacgaaacgtaacctacggtttaccctaccgtagacctaacggcttacggtaccttcgtacgtacgaccgtacccggaggacgtacgggttctaattacgtaacgtgtacggtaaacgcggaccctagtacgac

SEQ ID NO: 431407 - DNA, 863 bp, Homo sapiens
  misc_feature: GZ8MTXP02JL411.19.71.G05.1.454.CMB.2.raw
tcagtactctcgtgcacgaccggtgctcgatttagtgtcgtcgcaagagagaggggggcagagcctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccatccggtccggggacagacgtcgacgtacggacgaaccgtaggttcggttgtccgtttgggaccgtaccggttcggggtaccgacgggccgtaacccggttccccccgaagttacccggggaagggtaacgggttacccgtaagggtacgggtaccggggtaccgtttaaggggggaaacgtaaaccgttatttaaacgttttcgaaacgtttaccggttacccggaaaacgtaaaccgggttaaggggtaaaaccttaaaaccgttaaaagtttttacgacggtaccctaaacccgttaaatttaccgttaagggtttagggtaaacggttacgtacccggtaaccggttaagaaaccgtaaacgtaaaccgttaaacgggtaaaccaaaccgttaaacgaaccgttaacggaaaacccggtaaacccgttaccgtttaccccggtaccttaccggtaccgaacggtaccctacgtaaccccgtttcgtacggtaccgggtaaaccccttacccggggaaacggttaaccgggtacggggtttaccttaaaggtttaacccttaaggtaaccgggtacgggttaaaccgggacccgtaacccccgttaagtaaacccggg

SEQ ID NO: 431408 - DNA, 694 bp, Homo sapiens
  misc_feature: GZ8MTXP02I5AQ3.19.71.G05.1.454.CMB.2.raw
  modified_base (632)..(632): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctcccacaaggtgtcctgtcacaagtacagctgcagcagtcaggtccaggtactggtgaacgtcccctcggccaacgtaccccttctccgcctccaccttgtcgcccacgtccgtccggggacagacggtcgctacgcgacgtaggttcgttcgtcgtttggctacggtcggtcacgggccacgtccccgatccggagtacggtcgtagtacggtcgggcgtaggggaacgtactaatttacgtttacacgttcgtaccctaaacgtaccggtaggtaaaacttaactaaaagtttcgacgaaccctacgttattcgttaggttagaacggtacgtaccggtaattagaaacctaaacgtacgtaaaaccgttggaaacctaacgtaacgtaaaccggaaaacgtaaccgtaaccgttccgtacctacggacagtccgacgtaccctcgtacgtacgtcccgtaccggacggtaccgtacgggttnttaaacgttaacgtttaacgtacggtaacgggaaccgtacccgaaccccgttaagtaaaccg

SEQ ID NO: 431409 - DNA, 615 bp, Homo sapiens
  misc_feature: GZ8MTXP02ITFWU.19.71.G05.1.454.CMB.2.raw
  modified_base (301)..(301): a, c, t, g, unknown or other
  modified_base (462)..(462): a, c, t, g, unknown or other
  modified_base (514)..(514): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgcccctcgcacgaccctctcgctcacctgtcgccatccgtccggggacagagtcgctagcgactgtgttgcttggctacgtgggtcaggcacgtccccagtcggagaggtctaggnggtggcgtaggggaagtactatttacgtttcagtcgtaccaacgtaggtaggaaactactaaattagcgaccaacctattcgttagttaggaacggtacgtcgactagaaactaaataccgaaacgtagaaccagacgtaacgaaccgtaactacgttccncctgacacgtctacgtacctcgtgaccgtaccgaccggaggacgtacgggtnttaacgtattacggtaggacggtaacgcccggaccctaagtacgaactcgtacccggtaaccctaccgtttcgtccttggtacggttacgtacgtttaagg

SEQ ID NO: 431410 - DNA, 702 bp, Homo sapiens
  misc_feature: GZ8MTXP02IPQ26.19.71.G05.1.454.CMB.2.raw
  modified_base (244)..(244): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgaggcggccaccatcaactgacaagtccacgccactaattctttanaactacgttaccaaactaatacgtaaaactacttagcttaggtaccagaccaaggacgaccgaaggacacgcccttacgaggctcgcttactacttttaccgggtaccacgtaccgtaaccccggggtaacgtccccggggttaccccctacggacccgtacgtttaccgacggtcgggcccaggggtccggggttacgtacggggaacctagttactttaccacgttccctacaaccctagtacgacgtcacgtccctagccgaaggtactagaaagtgtaggtcggtactttaagttttagttaacttacgtaacctaaaattaattttaacttatttaaacgtaccgtttacgggttacggtaacccggtttaccggaaccggttaaaagggaccgtaagggtaacgtattaaacgtcgaaaacggtacgtaaccgtggtacggtactacgtaac

SEQ ID NO: 431411 - DNA, 774 bp, Homo sapiens
  misc_feature: GZ8MTXP02IZ2P1.19.71.G05.1.454.CMB.2.raw
  modified_base (251)..(251): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgaggccggccacatcaactgacaacgtccacgccaactaacttctttaanactacgttacccaaactaaataacgtaaaacttacttagtacgttacggtaaccagacaaggaacgaacccgaaggaccacgcctaccgtaggctgccttactacgtttacgcggtactacgtaccggtaacccggggtaacgttccccggggtcccctacgacccgtagttaccgaggtcggcgacgggggtccgggttacgtacggggtacctaaggttactttccgaaccttccctaaccctaaccctactaccgaacgtccgaccgttcccgtaggaccggtaacgggaccgtaaggtaaaggtacgttgggtaacggtttacgtttaaggtttttaaactttagtttaaccgtaaacctaaagtttaaatttaaacttttaagtttaacgtttacggttacggtttaaccgggttaccggttaaccgggaaaccggtaaacgggtaaccgtaaaggggtacgtaacgtaacgtaacgtaacggtaaacggttaacgtggttacgtacgtacgtaaccg

SEQ ID NO: 431412 - DNA, 659 bp, Homo sapiens
  misc_feature: GZ8MTXP02FRM69.19.71.G05.1.454.CMB.2.raw
  modified_base (235)..(235): a, c, t, g, unknown or other
  modified_base (329)..(329): a, c, t, g, unknown or other
  modified_base (652)..(652): a, c, t, g, unknown or other
  modified_base (658)..(658): a, c, t, g, unknown or other
tcagtactctcgtgcacgaccggtgctcgatttagtgtcgtcgcaagagagaggggggcacttctccctctaacactctccccagtctccagactccctggctgtgtctctgggcgagcgggccaccatcaactgcaagtccagccacaatcttttatacagttccaaacaatagaaaactacttagcttggtaccagcagagaccaggacagcctccaggctgctcatttacgnggctatccgtacccgggacgtcccggggtccctgaccgtatcagtcggcaggcgggtcgtaggacagtacttcactctacaccatcagcacgcngcgaggtctagaagtgtgtgtacttagtttatagtactacaaattaattattaattattacgttcggtacgggtaacggttaccggaacggtaaacgggtaaccgtaagggtagtaattacgtacgtaaacgtaaccgtaacgttcgggtacggtacgtacgtacctaaccgtacgttacgttacgtttaccttaccttaaccgttccccgttaccccgtacccgtacgttaccgtacgtaaccgtaacggtaggtaacgtacgtacgggacgggtcgggtacgtacgggtaaccgtaaggggacctaagaacgtaggactanacgcang

SEQ ID NO: 431413 - DNA, 700 bp, Homo sapiens
  misc_feature: GZ8MTXP02FZ2B7.19.71.G05.1.454.CMB.2.raw
  modified_base (254)..(254): a, c, t, g, unknown or other
  modified_base (334)..(334): a, c, t, g, unknown or other
  modified_base (428)..(428): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccaccgatacgaactgacaaacgtcccagcccaactaattcttttanaacagttaccaaacaaatgaaaactactagcttggaccagcagagacaggacacgcctcgaggctgctactatttacggnggactacgtacccgtaccggggtacgtcccgggtacccctacggacctagtcgaggtcggacgagggtccgggtgtaggactattactttaccncttactaccacctactacgagccacgtcgacgacgacgggtacgtaaggaaagtgtacgggtaggttacgtttaagtttttattacgttaacgttaactaaaaacgtttaactttaaatttaagtttaacgtttaaccggtttacgggttaacgggtacccgggttaccggggaaacccggtaaaacgggtaaccgtaaaagggttacggtaattaaccggtaacgtaaacggtaaccggtaaacggttggtacggtaccgtacggaacccg

SEQ ID NO: 431414 - DNA, 582 bp, Homo sapiens
  misc_feature: GZ8MTXP02I9IAS.19.71.G05.1.454.CMB.2.raw
  modified_base (367)..(367): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagagtctagagtggctggggaagacagtatttcatcgtccaaacacgtagaaatactaaaattntgacacctatctgttagagtagtcgactgactaactcaaacgtagaacacaatacgaaacgaaccgtacgttcctaccgtgacacggtacctacggaaccccttcgtgttaccggacccgtacccggaaacggtaccgaacgggggttcttaaacgttaacgtttaacgtcggttacgggaaaacggtaccgggtacccccctaagttaaaccgg

SEQ ID NO: 431415 - DNA, 624 bp, Homo sapiens
  misc_feature: GZ8MTXP02HFNC1.19.71.G05.1.454.CMB.2.raw
  modified_base (266)..(266): a, c, t, g, unknown or other
  modified_base (378)..(378): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgctatcgtccggggacagagtcgctagcgacngtgtgcttggcacgtgggtcaggccacgtccccagtcgagaggtctaggagtggcgtaggggaacggactagttattcatcgtaccacgacgtaggaaactaactaaattanacgaccactattcgttagttagagtacgtacgacttagaactaactacgaaacgtacgaacaacacgtaaccgaaacgtaaccgtacgtttaccctacccgttacgcgtacgtccgttacgtacccgttcgtacgtacgtacccgttacccggaagggtaaccgtaacggggttacgttaacgttaacgtttaacgtacgggttaacggaacggtaacccggtacccccgtaagtaaccgtaaccg

SEQ ID NO: 431416 - DNA, 587 bp, Homo sapiens
  misc_feature: GZ8MTXP02FL11R.19.71.G05.1.454.CMB.2.raw
  modified_base (245)..(245): a, c, t, g, unknown or other
  modified_base (339)..(339): a, c, t, g, unknown or other
  modified_base (398)..(398): a, c, t, g, unknown or other
  modified_base (407)..(407): a, c, t, g, unknown or other
  modified_base (457)..(457): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaagtccagccaactaattcttttaanacagttacccaaaacaatagaaaaacttcttaagcttaggtaacccagacaaggacaaccaggacagccctacgtaggctgctactatttacgngggacacgtccgtaaccccggggtagtccccccggggtcctagacctattcgagtgcgnggtcgggtntagggactagtatttcactctacactatacgaagcacgcctgcgaacggntagagtgtggtgtattagtttatagtactataataattattattagtacgttacgtacggtacgtacggaacgaaacggacgtaaggtagtaataacgtaacgaacgtacgtagtacggtacgacgtacg

SEQ ID NO: 431417 - DNA, 746 bp, Homo sapiens
  misc_feature: GZ8MTXP02INOTU.19.71.G05.1.454.CMB.2.raw
  modified_base (332)..(332): a, c, t, g, unknown or other
  modified_base (348)..(348): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccaccatcaactgcaacgtccacgcccaactaacttcttttaataacctaagttaccaaacaaataagtaaaactacttagtcttaggtaaccagacaagacgaccaaggacacgtcctcaggcngtctactactttacgnggcaagtccgaccgggaagtccccggggtccccaggtacccattccgaggtcggacgtacgggtccggggtatacggggaacctagttactttaccaacctcctaccgaaccctaactcgacggcccacgtaccgtcgaacggtacgggactaaggaaacggtagttacggttagggttactttaaagggtttttaacgttagtttaacgtaaacccttaaaagtaaattttaaactttttaaaggtttaaactttacgtttacccgggttaacggggtttacccggtttaaaccgggggaaccccgtaaaaagggggtaaccctaaagggggttaacggtaaactaacgttaacggaaacgtaacggtaaaacgtgggtacggacgtttacgaaccc

SEQ ID NO: 431418 - DNA, 776 bp, Homo sapiens
  misc_feature: GZ8MTXP02GOCFI.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctcgtcgcctcaccgtgtcgcctagtccggtaccgggacagacgtcgactaggcgacgtagttgtcgcgttggctacgtcggtcacgggcacgtccccgagtcggaggtacggtacgtaggtaggtcggtacggtaggggaaacgtactacgtttacgtttacgaacgttcgtaaaccgaacgtaaccggtaggtaaaaccttaaactaaatttacgtaccggtaacctaacccgttagttccggttggtttaaacggaaacgggttacggtaccgtaaacgttaacggaaaccctaaacgtaaccgtaaaacggttaaacgaacctaaaccgtaaacgttaaaccgaaaaccgttaaaaccgtttcggtttacccctaccgtttacgaccgtaacggttacccttacggttacccttcgtacggtacccgtaccgtacccggagtaaccggtacgggttataacgtttacgtacggttacgacggggtaaaccgacccggtaccgtacgtacgaaccgtcgtacccgaaccgttcccttcggtaccttacggttacggttacgttactttaaccggg

SEQ ID NO: 431419 - DNA, 728 bp, Homo sapiens
  misc_feature: GZ8MTXP02I956Y.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccactcgtccggggacagacgtcgctacgcgacagtgtgcttggcacgtggtcaggcacgtccccagtacgagtacgtcgtagagtggcgtaggggaagactagttactttcgagttcgtacccgaaacgtacggtaaggtaaaacttaactaaaaagtttactacgaacctaacccgtaagttccgttaggtttaacggaaggttacgtaccggtaaaccttaggaaaacctaaaacgttaccgtaaaaaccggttaacgaaacccgtaaacgtaaacgttaaccggaaaaccgtaaaaccccgttaacggtttccctaccccggttacggaacctaccgggtaccttaccggtaaacccctttcgttacgggttacccgaacccggttacccggaaacgggtaaccgtaacgggggtttactaaacgttaaccgtttaacgtcggttaaacgggaaacgtaccccggtaccccgtaagtaaacccgg

SEQ ID NO: 431420 - DNA, 568 bp, Homo sapiens
  misc_feature: GZ8MTXP02IJ0CW.19.71.G05.1.454.CMB.2.raw
  modified_base (221)..(221): a, c, t, g, unknown or other
  modified_base (253)..(253): a, c, t, g, unknown or other
  modified_base (318)..(318): a, c, t, g, unknown or other
  modified_base (375)..(375): a, c, t, g, unknown or other
  modified_base (389)..(389): a, c, t, g, unknown or other
  modified_base (417)..(417): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttctcttcttctgccgtgctgggcctccacaaggtgtcctgtcacaagtacagctgcagcagtcaggtccaggactgggtagaacgcccctgcacgaccctntccgctcactgtcgcctagtccgtccgggganagacgtcgctagcgacagtgtgcttggctacgtgggtcaggcacgtcccagtcgagagtctaggngtggacgtagggaacgtactatatttcagttcgacagtagtagaaatacgtaaattngacactatctgtanagtagtacgatagaactagtacaacganaacacagttacgaaagtacctacgttccacccgtagacacgtacgtcgaaccttcgttcgtacggtacccaccggtaacggaaccggttacgggttaactaacgttagttaacgtcgggtaaacggacgaccggtaccctaagtacgaccg

SEQ ID NO: 431421 - DNA, 750 bp, Homo sapiens
  misc_feature: GZ8MTXP02HHDPY.19.71.G05.1.454.CMB.2.raw
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaacaattcttttaatacagttccaaacaaatagaaaactactagcttaggtaccagcagagaccaggacagcctctaggctgctctatttacgtcgggacaagtccgtaaccccggggtaagtccccggggtccctaccggtaacccgtatttaccgacggtggccgaagggtccgggggtacggtcgggggaacctaacgggtaactttttccgaacctttcctccctaaaccctaacttaccaacgaccgaacgtccctcggaccgaacgggtaccttacggaaaggtaagttgggtacggggtactttaaaggtttttaatttaaggtttacggtaaccctaaaacttaaaatttaacgtttaaaatttaaatttaaccgtttacgggttacgggttaaaccgggtttccgggaacccgtaaaacgggggtaaacccgtaaagggggttacgtaaacggttaagttacgaaaacggtaacggtaaaacggttggttacgggaaccttacggacctaaacccg

SEQ ID NO: 431422 - DNA, 639 bp, Homo sapiens
  misc_feature: GZ8MTXP02FZUCI.19.71.G05.1.454.CMB.2.raw
  modified_base (255)..(255): a, c, t, g, unknown or other
  modified_base (352)..(352): a, c, t, g, unknown or other
  modified_base (386)..(386): a, c, t, g, unknown or other
  modified_base (397)..(397): a, c, t, g, unknown or other
  modified_base (448)..(448): a, c, t, g, unknown or other
  modified_base (453)..(453): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtcgcccgacggggacatcgtgatcgacccagtcctaccagacctcccgtggtctgtcgtctcgtgggcgaggccgggccacatacaactgacaacgccagaccaactaattctttaanactacttaccaaaacataaacgtaaactacttagcttacggaacagacgaagacgaaccgaggaccacgtcctaccgtagctgtactctaagttcgnggactacgtccgtaaccggtacgtccccggtccncgactctacgngcgcgtcggacggtcgacgtactagtactacacgtctacacacgtcagccncgtcngacgacgtagagtaagtcggtggttacgtagtttagtttaagttattacgtaaacttaaatttaatttatttaacgtttacgttacggtttacggtaccggttaaccggtaccgaaacgggtaacggaacggtaaggtacgtaagtaacgtacgtaaacggtacgtaggttacggtacgtactacg

SEQ ID NO: 431423 - DNA, 633 bp, Homo sapiens
  misc_feature: GZ8MTXP02HOI1R.19.71.G05.1.454.CMB.2.raw
  modified_base (253)..(253): a, c, t, g, unknown or other
  modified_base (317)..(317): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctctcgctcacctgtcgccatcgtccgggganagagtcgctagcgacagtgttgcttggcacgtggtcaggcagtccccatcgagaggtctaaggngtggcgtacgggaagactattattcagttcgtaccaacgtacgtaagtaaactaactaaattacacgacctaacgtagttacgtagttagaagtacgtacgtaacgtaacgaaactaaacgtaacgtaaacgtaacgaaaccgtaacgtaaacgtaaacggaaaccgtaaacccttacgttacccgtacccgtacgaccgtacgtaccgtacgtaccgttcgtacggtaccgaacccgtaccggaaacggtaccgtaacgggttacttaagttaacgtacggtacggtaacggaacggaccgtacccgtaagtacg

SEQ ID NO: 431424 - DNA, 656 bp, Homo sapiens
  misc_feature: GZ8MTXP02F2UBJ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctccacctgtcgcctactccgtccggggacagagtcgctagcgacagtgttcgcttggctacgtgggtcaggaccacgtccccagtcgagtaggtctaggagtggacgtaggggaagacctattactttcgacgttacgtacccaaacgacggttaaggtaaactaacctaaaatttacgtacgaacctaaccctagttaccgtaggttaggaagtaacgtccgtaactacgaactaaagtacgaaaacgtaacgaaactaacgtaagtaaccggaaaacgtaaccgtaccgtttacccgacccgtggacctaacgtccgttacgtaaccccttgtacggtacgtaaccgtacccggaaaggtacccggtacgggttattaactaacgtttaacgtaggtacggaaacgcccgaacccgtagtaacg

SEQ ID NO: 431425 - DNA, 808 bp, Homo sapiens
  misc_feature: GZ8MTXP02GE8ET.19.71.G05.1.454.CMB.2.raw
  modified_base (221)..(221): a, c, t, g, unknown or other
  modified_base (238)..(238): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtagaacgccctcgcacgacccctctccgctccacctgtcnccagtccgtccgggganagacgtcgctaggcgacgtagtgttcgcgttggcacggtggtcacggcacgtccccagtcgaggtcggtacaggtaggtcggtacggtaggggaaacgtacgttaactttacgtttaccgaacgttcggttaaaccccaaaaggtaaccgggttaaacggtaaaacctttaaaacccgtaaaactttacggtaccggaccttaaacccttagtttccgttagggtttaacggaaacggttacgttaacccggtacgttaaacgaaacgtaaaaccgtacggtaaaacgttaacgaaacctaacgaacgttaacgaaaccggttaaacctcgtttaccccgtacccgtggtacctacgtaccgttacggttacccttacgggtacggttaccgaccccggtaaccggtagggtaacccggttacggggttaacttaacgttacgtttacggtaacggttaacgggaaaccggtacccggtaacccgtagtaaccgtaactacggtttaccccgccgttaaccccggttcgtttacccggtagtttccgggtacgtacgttttaaaccgggg

SEQ ID NO: 431426 - DNA, 599 bp, Homo sapiens
  misc_feature: GZ8MTXP02F13JF.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagtgtgcttggcactgggtcaggcagtccccatcgagaggtctagagtggcgtgggaagacatatttcatgtaccacgacgtaggaaatacaaattatgacaccatctagttgagagtacgactagaactaagtacaacgtaagacaactaagtcgaaaagtaaacccgtagttaccctacccttaggacctaaacggtcctacggtaaccccttcgtacggttaccgaacccggttccccggaaagggtaaccgtaccgggggttaattaacgttaacgttaaccgtaggtacgggaaaacggtacccggaaccccctaaggtaacggtaaaccg

SEQ ID NO: 431427 - DNA, 580 bp, Homo sapiens
  misc_feature: GZ8MTXP02FJKKM.19.71.G05.1.454.CMB.2.raw
  modified_base (300)..(300): a, c, t, g, unknown or other
  modified_base (309)..(309): a, c, t, g, unknown or other
  modified_base (420)..(420): a, c, t, g, unknown or other
  modified_base (425)..(425): a, c, t, g, unknown or other
  modified_base (458)..(458): a, c, t, g, unknown or other
  modified_base (500)..(500): a, c, t, g, unknown or other
  modified_base (549)..(549): a, c, t, g, unknown or other
  modified_base (571)..(571): a, c, t, g, unknown or other
tcagtactctcgtgcacgaccggtgctcgatttagtgtcgtcgcaagagagagggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccgggggacaggagtcgctagccgaactagtgttgtcgttggctacgtgggtcagggccacgtccccagtcggagnggtctaggngtggcgtagggaagactaatattcgattcgtaccaacgtacggtagaaacttaactaaattatcgacacctattcgtgtagacgtagtcactgaaactagtacaaacgtanaacanaactaccgaaagtacctacgtcctccctagacncgacttcgaactgtacgtacacccgtcgagtcgtaacggttntattacgtgtacggtaacggacgaccgtacccaagtacgactacgtccnccgtacttcgtctgtacggtanacgttaacg

SEQ ID NO: 431428 - DNA, 600 bp, Homo sapiens
  misc_feature: GZ8MTXP02IX66Z.19.71.G05.1.454.CMB.2.raw
  modified_base (244)..(244): a, c, t, g, unknown or other
  modified_base (336)..(336): a, c, t, g, unknown or other
  modified_base (393)..(393): a, c, t, g, unknown or other
  modified_base (457)..(457): a, c, t, g, unknown or other
  modified_base (475)..(475): a, c, t, g, unknown or other
  modified_base (484)..(484): a, c, t, g, unknown or other
  modified_base (493)..(493): a, c, t, g, unknown or other
  modified_base (573)..(573): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccggccacatacaactgacaacgtcacgccataattcttttanacagttaccaaacgtaaatataaaacctacttagtacttaggtaccagcaagagaccaggacagccctcgtaggctcgtactctatttacgngggcctacgtaccgtacccgggagtccccggggcccctgaccgtatccgagtcggcngggtcggtcgtaggaccagtactttcgacctctaccacctatacgacgtaccacgcccgttcgngtaacgcgttagaaagtntggtacgtnttaagtttnttagttagactaaatagttaatttacttatcgtttaggtcgtaccgttacggaccgtaaggaacctagggtagattacgngaacgtacgtacgtggtcgactcgacc

SEQ ID NO: 431429 - DNA, 585 bp, Homo sapiens
  misc_feature: GZ8MTXP02JECFJ.19.71.G05.1.454.CMB.2.raw
  modified_base (242)..(242): a, c, t, g, unknown or other
  modified_base (253)..(253): a, c, t, g, unknown or other
  modified_base (322)..(322): a, c, t, g, unknown or other
  modified_base (366)..(366): a, c, t, g, unknown or other
  modified_base (382)..(382): a, c, t, g, unknown or other
  modified_base (441)..(441): a, c, t, g, unknown or other
  modified_base (475)..(475): a, c, t, g, unknown or other
  modified_base (568)..(568): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacatcaactgacaagtccagccacaattctttanactagtccaanaatacgaaaactctagtcttaggacagcagacgaccaggacagcctactaggctagcctatatttacgnggcactccgtacccgggtagtccccggggtcccctacgaccgtnttaccgaggtcgacgngggtcgggtactaggggaccagtactttcacctctacactgacagcacgccctgaccgnggtctagaagtgtgtcggtactagttttatagtnactaataatttattattacgtacgttggacggttccgttacggaccgtaaagggtacctagggtacgtaatacgttaacgagaaccgttacgnggttacgcgtacgtacc

SEQ ID NO: 431430 - DNA, 673 bp, Homo sapiens
  misc_feature: GZ8MTXP02IQ2K4.19.71.G05.1.454.CMB.2.raw
  modified_base (229)..(229): a, c, t, g, unknown or other
  modified_base (238)..(238): a, c, t, g, unknown or other
  modified_base (240)..(240): a, c, t, g, unknown or other
  modified_base (250)..(250): a, c, t, g, unknown or other
  modified_base (261)..(261): a, c, t, g, unknown or other
  modified_base (265)..(265): a, c, t, g, unknown or other
  modified_base (281)..(281): a, c, t, g, unknown or other
  modified_base (307)..(307): a, c, t, g, unknown or other
  modified_base (316)..(316): a, c, t, g, unknown or other
  modified_base (631)..(631): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccacatcaactgcaagtcagccanaatctttananagttccaaanaatgaaaactnttancttggtaccagcaganaccaggacagcctcgtaggctgctanatttaccgngggctactccgtaccccggggaaattcccggggtaccccctaggaaccgatttaccgaggttcggacaggggtccgggttacctgggggaacctaggtacttttaccgaaccgttcttaccaacccgtaactccgaaagcccgaagtccccgttgacccgtaagggtcctaaggaaaacgtgttcggacgggttaccttaaggttttataacgttgtaacctaaaacgtaattaacttagtttaaacgtacgttcggtaacggtaccgtttacggaccgttaaaagggaccttaaacggggtacggtattaaacncgaaacggtaaccgtaaagtcggtaacggtactcggtaaccg

SEQ ID NO: 431431 - DNA, 472 bp, Homo sapiens
  misc_feature: GZ8MTXP02GCER8.19.71.G05.1.454.CMB.2.raw
  modified_base (367)..(367): a, c, t, g, unknown or other
  modified_base (375)..(375): a, c, t, g, unknown or other
  modified_base (377)..(377): a, c, t, g, unknown or other
  modified_base (379)..(379): a, c, t, g, unknown or other
  modified_base (381)..(381): a, c, t, g, unknown or other
  modified_base (385)..(385): a, c, t, g, unknown or other
  modified_base (391)..(391): a, c, t, g, unknown or other
  modified_base (393)..(396): a, c, t, g, unknown or other
  modified_base (398)..(399): a, c, t, g, unknown or other
  modified_base (402)..(402): a, c, t, g, unknown or other
  modified_base (405)..(405): a, c, t, g, unknown or other
  modified_base (409)..(409): a, c, t, g, unknown or other
  modified_base (448)..(448): a, c, t, g, unknown or other
  modified_base (451)..(451): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctggaagacatattcatgtccaacacgtggaatacaaattatgcaaccatctgttgagagtcgactgacaaatnaaacgtananananaganacatcncnnnncnnctntgngacnccgagacgacgtgtatatatgagagacgaccacacacanacncactctctcgtcgtcgactag

SEQ ID NO: 431432 - DNA, 644 bp, Homo sapiens
  misc_feature: GZ8MTXP02H6XCD.19.71.G05.1.454.CMB.2.raw
  modified_base (269)..(269): a, c, t, g, unknown or other
  modified_base (343)..(343): a, c, t, g, unknown or other
  modified_base (390)..(390): a, c, t, g, unknown or other
  modified_base (416)..(416): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcctggctgtctcgtcgtgggcgaggccgggccaacgatacaactgacaacgtccagaccaactaattcttttaagactacgttaccaaanagtacgaaactctagtcttaggaaccagctaggacgaccaggacacgtacctcgtaggctgctataatttacgnggtacattaccccgaaaccggggtatcccggggtccccagaaccgtnttacgagtggcgtaggccggggttanacggtactacgttcttcactcctacactcgtacacgcgtacgtactacgacgcggtagtaaggacgtgttacggttacgttaagttacgtttaattagtaaccgtaaactaaatttaatttacttaaattacgttacgttacggtacgtcgtacggaaacgtaacggggtaactaggtacgtaacgtacgtaacgaggtaaccgtagtcggtacgtacgtacgaaccg

SEQ ID NO: 431433 - DNA, 668 bp, Homo sapiens
  misc_feature: GZ8MTXP02GX8ZK.19.71.G05.1.454.CMB.2.raw
  modified_base (316)..(316): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgggtgaagccctcgcagaccctctcgctcacctgtgccatccgtccggggacaggagtcgctagcgacaggtgttgcgttggcacgtggtcaggcacgtccccagtcgaggaggtctaggagtggcgtaggggaaganaattatttacatcgtaccaacgtacggtaggaaacttaaactaaattagacgacctacctattcgtgttaggaagtacgtcgaactagaactaactacgaaacgttaacgaacaacaacgtaacgaaacgtaaccgtacgtttccgtacccgttgaccgtacgtacctacggtaaccctcgtacggtaccgtacccggtacccggtaacgggaacggttaacgggttacgttaacgtttaacgttacgttacgggtaacgggaaccggtaccgacccccgtaaagtaccgtaactacgtacggtcccgtacccgttaccgtaccgtacggttcggtacgtacgtttaaacgg

SEQ ID NO: 431434 - DNA, 618 bp, Homo sapiens
  misc_feature: GZ8MTXP02JJXUK.19.71.G05.1.454.CMB.2.raw
  modified_base (376)..(376): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctccacctgtcgccatcgtccggggacaggagtcgctagcgactagtgttgcttggcacgtgggtcaggcacgtccccagtcgagagtctagagtggcgtagggacgactatattcatcgtaccacgacgtaggaaactaacgaaatttacncgacacctagttctagttagagtacgtacgactgaactaagtaccgaaagtacgaacacgtaacgtaccggaaacgtaaccgtaacgttccttaccccgtaggacctaacggtctaaccgtccttacgtacggtaccggacccttacccggggaacggtaaccggtacggggttacgttaagtaaccgtttaacgttagggaaacgggtaacgtacccgggacccctaaaggtacggtaaac

SEQ ID NO: 431435 - DNA, 599 bp, Homo sapiens
  misc_feature: GZ8MTXP02GO25X.19.71.G05.1.454.CMB.2.raw
  modified_base (244)..(244): a, c, t, g, unknown or other
  modified_base (256)..(256): a, c, t, g, unknown or other
  modified_base (440)..(440): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatcgacccagtctccagacctcccgtggctgtgtctcgtgggcgagcgggccacgatacgaactgacaagtccagccataattcttttanacagttaccaanaatacgaaactactagtctaggtttaccagcagagaccaggacacgcctctaggctgctactatttacgacgggacactccgtaaccccgggtaagtcccggggtcctcggacccgtattacaggtcgcacggtcggggtgtgggactagtacttctactcctacacaacacgacacacgtcgngcgagacgtagagtagtagtagtacgttagttattattacgtactaactaattaattacttacgttacgttagtacggtacggtacggtacgaacggtaacggtaacggtagtacgtaagtacgtaacgaacgtacgtacgtacgtacgtacgactacg

SEQ ID NO: 431436 - DNA, 588 bp, Homo sapiens
  misc_feature: GZ8MTXP02JUNAL.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctagggaaggacatagtttcaattcgtaccaaacgacggtaggaaactaacgaaaatttatacgccaaccattccgtgttagagtacgtcgacttgaacaatacgaaacgtacgacaacaagtacgaaagaacctagttacctccctgactagctcgacctcgtagtacgacctacccggagacgtacgggtagttatagttactaggtacggaaacgaccggaccccaagttacgaactacgacggaaccctaaccggttaccgttactaccgtggttccggactttaaacgg

SEQ ID NO: 431437 - DNA, 754 bp, Homo sapiens
  misc_feature: GZ8MTXP02JICOY.19.71.G05.1.454.CMB.2.raw
  modified_base (218)..(218): a, c, t, g, unknown or other
  modified_base (243)..(243): a, c, t, g, unknown or other
  modified_base (261)..(261): a, c, t, g, unknown or other
  modified_base (282)..(282): a, c, t, g, unknown or other
  modified_base (390)..(390): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcggcacgaccctctcgctcacctgtcnccagtccgtacggggacagacgtcncgtagcgactagtgttcncgttggcagtcggtcacggcncgtccccatcggaggtagtcgaggtacggtggcgtaggggaagtactaatttacttaccgaattccgtaaccgaaccgtaaggtacggaaaacttaaactaaatttanacgacaaccttaacgttgttaggttagaaggtacgtacgacgtacgaaactaagtaactaaaccggacgtaacaacgaacgtaacgaaaccgtaaacttaccgtttaccaccccgttagacctaaccggtaccttacccggtacccttcgtacgggtacccgttaaccccggaacccgggtaacgggtacccggttaaggggttaactttaaacgtacgtttaaccggtaacgggttaaacccgggggaaaacgggtaaaccccccgggtaaacccttaagggaaacccgtaacgttcccgaacccggttaacctaacccgtttcggttacccgtggttaccggtacgttacggtttaaacggg

SEQ ID NO: 431438 - DNA, 697 bp, Homo sapiens
  misc_feature: GZ8MTXP02FFTRD.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatcgtccggggacagagtcgctagcgacagtgttgcttggcacgtgggtcaggcagtccccatcgagaggtctagacgtggcgtggggaaacggactataattttcaacgtttggcccaaacgaccgtagggaaaacttaacctaaaaatttactagtaccaaacccgtaaattccgttaggtttaggaaggtacggttcggaaaccttaggaaaccaaacttacgaaaaccgggttaacgaactaacctaaagtaaccgtaaaacgggaaacccgtaaaccgttttcctaaccccgtcggtaccaaaggacctcggtaacccgttacctcggttacggtaacccgtaccccggtaaccgggaaccggtaacccggggtacggttaacttaaagtttaaccgttaacggttaaggggtaaacggtaaaccggggtaacccccgtaacctaaaaccgg

SEQ ID NO: 431439 - DNA, 721 bp, Homo sapiens
  misc_feature: GZ8MTXP02INYSZ.19.71.G05.1.454.CMB.2.raw
  modified_base (307)..(307): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcactgtcgccatcgtccggggacaggagtcgctagcgacagtgtcgcttggcacgtgggtcaggcacgcccagcgagnggtctagagtggcgtagggaacgactagttatttcagttcgaccacgtacgtaaggtaaactaacgtaaaatttacgtacgtacctaacctattaccgttggttaggaggtagttaccgtaacttacggtaaacaaacttacgaaaccgttaaacggaacctaaacaacgttaaacggaaaaccgttaaacccgttaaccggttttaccttaccccgtacgtacccggtaacggttccctaccgttaaacccgtccgtttaccgggttacccggtaaacccggttaaaccccgggaacggggtaaacccggttaacggggtttaccgtttaaaagttttaaccggttaaaggttacgggttaacggggaaaacggtacccggtaaccccccgtaaagttaaccggtaaaacccg

SEQ ID NO: 431440 - DNA, 566 bp, Homo sapiens
  misc_feature: GZ8MTXP02IJSEY.19.71.G05.1.454.CMB.2.raw
  modified_base (223)..(223): a, c, t, g, unknown or other
  modified_base (310)..(310): a, c, t, g, unknown or other
  modified_base (380)..(380): a, c, t, g, unknown or other
  modified_base (400)..(400): a, c, t, g, unknown or other
  modified_base (416)..(416): a, c, t, g, unknown or other
  modified_base (441)..(441): a, c, t, g, unknown or other
  modified_base (450)..(450): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctntcgctcacctgtgccatcgtccggggacagacgtcgctagcgactagtcgttgacttggcacgtgggtcaggcacgtcccatcgagngtcagacgtggcgtgggaacgctagttattcgaatgtaccaagacgtaggaatacgaaattactgacacnttactgtagagtatcgatanactaatcaaacggtanactaacagtaccgaaagtaaacccngtttacccncgtagctagtccgtacgtacccttgtacggtactacccgtaaccggtaacggaacgttacgggttacttaaataacgttacgtacggtacggaacgaccggtaaccctaagtaacg

SEQ ID NO: 431441 - DNA, 711 bp, Homo sapiens
  misc_feature: GZ8MTXP02FHW10.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgcccctcgcacgacccctctccgctcacctgtcgcccatccgtaccggggacaggacgtcgctacgcgacagtgttgcttggctacgtggggtcaggcacggtccccagtcggagtacggtcgtaggaggtgggacgttaggggaaacggtactagttactttacagttcgtacccgaacgacgtaagggtaaaacttaaacctaaaatttagacgacctaacctaattcgttagttaggaacggtaacgttccgaactacggaaacgtaactaaccgtaaaacgtaacgaaccgtaaacaacgttaaccggaaaacggtaaaaccccttaacggtttccccctaacccgttcggtaacccgacggtaccctaacgggtcccttaccgttacgggtaccggtaaccctacccggggaaaggtacccggtaaccgggggttattaacggtttaacttaacggtggtaaacgggaaccggtacccgaccccgtaagtacggtaaccg

SEQ ID NO: 431442 - DNA, 593 bp, Homo sapiens
  misc_feature: GZ8MTXP02FE651.19.71.G05.1.454.CMB.2.raw
  modified_base (247)..(247): a, c, t, g, unknown or other
  modified_base (322)..(322): a, c, t, g, unknown or other
  modified_base (330)..(330): a, c, t, g, unknown or other
  modified_base (371)..(371): a, c, t, g, unknown or other
  modified_base (389)..(389): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatacaactgacaaagtccagccaactaattcttttaanacagttcaaacaatagaaaactacttagcttggtaccagcaagacgacctaggacagcctacgaggctagcttanatttacgnggctatccgaccgggaatcccggggtacccctcgaaccgtntcgagcgcgtggcgggtntggactatacttcactcacacatcagcacgctagacgagactagaagtgtggtacgtactttagtttaattagttacgtaaactaaacttaattaattagttactacgttcggtacggttaccgttaccggaaacgtaaacgggtaaccgtaagggttacgaactaagaacgtaacgtaacgtacgtagtacgtacgtacgacg

SEQ ID NO: 431443 - DNA, 567 bp, Homo sapiens
  misc_feature: GZ8MTXP02FEKFN.19.71.G05.1.454.CMB.2.raw
  modified_base (225)..(225): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctntcgctcacctgtcgccatcgtccggggacagagtcgctagcgacagtgttgcttggcactgggtcaggcacgtccccatcgagaggtctagaggtggctaggggaaggacagtatttcattgtccaaacacgtaggaaataactaaaattatgacaccatctagttgagtagcgactagacaaattacgaaacgtagacacatacgaaacgaaccacgttcctaccctgcaggctacgaacctcgtagtacgtaccgtacccggaacggaccgtaaccgggtaggttaaataacgtttaacgttaggacggaacggaaccgggacccccaagttaaaaccgg

SEQ ID NO: 431444 - DNA, 695 bp, Homo sapiens
  misc_feature: GZ8MTXP02G8ZI9.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtagaagcccctacgccagaccctctcgctcacctgtgcccatccgtccggggacaggtacgtcgactaggaccgactaggttgttgcgtttggctacgtggggtacacggcacgtccccagtcggagaggtcaagacgtggcgtaggggaagtactagttactttcgagttacgtacccaaacgtaacggttaaggaaaactttaaccgtaaaaatttacgtacggtaaacctacctacgtttacggttaggttaaggacggttacggtaccggtaacttaacggaaactaaacgttaccgaaaacggtacgaaaccgtaactaaacgtaacccgggtaaaactaaacccgttaccggttaccccttaccgtacggaccgtaccggtacttaccgacccttggtacgttaccggacccgttaccggaagaccggtaacggtaagttaactaacgttacgtacggaaggaaccgaccgtaacccgagtaaccg

SEQ ID NO: 431445 - DNA, 699 bp, Homo sapiens
  misc_feature: GZ8MTXP02JIC7I.19.71.G05.1.454.CMB.2.raw
  modified_base (242)..(242): a, c, t, g, unknown or other
  modified_base (289)..(289): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacngtgttgcttggcacgtggtcagggcagtccccatcgagaggtcaggngtggctggggaagacattagtttcattcgtaccaaacgtacggtagggaaacttaccgaaaagtttactacggactaaacccgaattccgttaggtttacggaaggtagttacccgaaacgttgggaaaccaaaacgttaccgaaaaccgttaacggaaccaaactaacgttaaccggaaaacggtaaaccccctaaggtttaaccctaccccgtggtaccaaacggcttacggtacccttacggtcgttagacccgttccccggaagggaccgtacggggtacttaaagtttaatacgtttagggtacggtaaacggacccgggtaaccccctagttaaacccggtaaacgaccgtaccgaaccccgtaccgttacgttaccgtacgttacggttcgtacgtttaacgg

SEQ ID NO: 431446 - DNA, 635 bp, Homo sapiens
  misc_feature: GZ8MTXP02G5ZZ1.19.71.G05.1.454.CMB.2.raw
  modified_base (303)..(303): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctccacctgtcgccagtccgtccggggacagacgtcgctagcgacagtgttgcgttggctacgtggtcaggcacgtccccagtcggagtaggtcaggnggtggcgtaggggaaggactagttagtttacagtccgtaaccgaacgtacggtaaggtaaactaacgtaaattacgacgtaccaacgtacttcgttaggttagaggtacgtcgtactagaactaagtacaaacggtacacaacagtaacgaaacgtaccgtacttcccaccgtgacgactcgacgtaccttgtacgtacgacccgtacggacggaacgttacggggtataacgtttacgtacgtacgggtacgaaccggaccgtaccccgaagtaccgactaacgtccgaacccgttactcgttcgtaggtacgtccgtagtttaaccgggg

SEQ ID NO: 431447 - DNA, 634 bp, Homo sapiens
  misc_feature: GZ8MTXP02I7S76.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgtgcttggcacgtggtcacggcacgtcccagtcgagacgtctagagtggcgtagggaagtactattactttcagttcgtccaaacgtacgtaggtaaactaacgtaaattagtcgacacctatcgttagtcgaagtacgacctagtacgaactaagtaccgaaaacggttacaaccaacggtaataaccggaaacggtaaacccttacgtttccctcccgttaggacctacgtacgtacgtaacccttcgtacggtacgtacccgttaaccggggacgtaacccggtacggggtttattaaacgttaacgtttaacggtagggtaaacgggtaacggaccccggtaccctaaagtaacccgg

SEQ ID NO: 431448 - DNA, 653 bp, Homo sapiens
  misc_feature: GZ8MTXP02FIKL2.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtgaacgccctcgcacgaccctctcgctcacctgtcgccacgtccgtccggggacagacgtcgctacggcgacaggttgttgcgtttgggctacgtggggtcaggccacgtccccagtcgagtaggtctaggagtggcgtaggggaacgactagttatttcagttcgtacccaaacgacggttaggaaactaactaaattacgtcgaccaaccgttatacgttaggttagaagtacgtacgaactagaactaaacttcgaaaacggtacgaaccaacgagtaaccgaaaagtaaccctacgtttaccctacccgttaggaccaacggtcctacggtaacccgttcgtcggttaaccggacccgttacccgggaaacgggtacccggtacggggttacttaacgttaacgttaacggtgggtaacggacggacccggacccctaagaaccg

SEQ ID NO: 431449 - DNA, 686 bp, Homo sapiens
  misc_feature: GZ8MTXP02JL2S8.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgcccatccgtccggggacagacgtcgctagcgacagtgttgcttggcacgtgggtcaggccagtcccccatccggagacggttcgagtagtggcgtaggggaaggactagttatttccgagtacgtaccaaacgacggttacggaaactaacgtaaaatttatcggaccaacctaattcgtagttagaaggtacgtaccggaactttagaacctaaaacgttaccgaaaaccggttaacgaaaccgtaaacgtaaacgtaaacggaaaaccgtaaaacccgttacgtttaccccgtaccccgtagaccgaacggtaccgtacgtaacccgtttacgtacggtaccggtacccgtaacccggtaacgggtaaccggttaccggggtattaacgttaacgttaaccgtaggtaaacgggtaaaccggtaccccggtaaccccgtaagtaaccg

SEQ ID NO: 431450 - DNA, 741 bp, Homo sapiens
  misc_feature: GZ8MTXP02HMN7R.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgcctcacctgtcgcctacgtccggtaccggggacacggacggtccgacgtacggacgacgtagttggttgtcgtttcggcctacgggttggggtaccgacggaccgtaccggtcccccgtaaggtacccggaaggtacggttaccgtagggtaggtcgggacggttaaggggaaacggtaactagttacgtttacaacgttcgtaccctaaacgtacgggtaaacgtaaacttaaaacgtaaattacgtacgtaccctaaccgtaagtttcggtaggttacggaagttacggtaccgtacgtaacgtaaaaccgtaactaccgtaaaacgtacgaaaccaaacgtaagtaaccggaaacggttaaaccctcgtttacccaccgtgtaaccgtacgtacccgttacggacctttcggacggtaccgaacccggttacccgggaaggtaccggtacggtttacttaacgttaacgttaaggtcgggtaacgaaacggtccccgaccggtaaataccg

SEQ ID NO: 431451 - DNA, 738 bp, Homo sapiens
  misc_feature: GZ8MTXP02GD4ZI.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtcgtcctgtcacaagtacagctgcagcagtcaggtccaggacgtggtagaacgccctcgcacgtaccctctccgcctaccaccctggtcgccgtacgtccggtacccggggaacacggtcgtacgcgtaggccgtaacgtaggtgttcgtccgttcggcctacggtcgggtacgacgggcctaccgtccccgatcggaggtacggtcgtagaggtggacggtaggggaacggactaattattacgattacgaccgtaaacgacggttaaaggaaattaaactaaaagtttagtacgacccgtaacctagttacgttagttacggaagtacgttaccgacgttaacggaactaaaacgttaaccgaaaacgggttacaaaccgttaaacacgtaaacgtaaaaccggtaaaccgttaccggtttacctacccgttacgacgtacggtccttaccgtaccttacggtacgtaccgtaacccggtaccgggtaaacggcccgggttaaagggttactttaagttaacggttacggtaacgggtacgggtaaaccggtacccgtaaaccgtaacgtaaacccgg

SEQ ID NO: 431452 - DNA, 608 bp, Homo sapiens
  misc_feature: GZ8MTXP02IO7VR.19.71.G05.1.454.CMB.2.raw
  modified_base (281)..(281): a, c, t, g, unknown or other
  modified_base (298)..(298): a, c, t, g, unknown or other
  modified_base (409)..(409): a, c, t, g, unknown or other
  modified_base (602)..(602): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctcttcctcttctcctgccgtgctggcctccacaggtgtcctgtcacaagtcagctgcagcagtcgaggtccaggctggtacgaacgccctcgcacgtaccctctcgcctcaccttgtcgcctacgtccgtaccgggacacgacgtcgacgtagccgaatgtgttncgtggcacgtggtacgnggtcctaaccgtcccaagtccggagtacggtataggacggtggacgtagggacgtactatttacgttacagttacgtaccacggtagtaaggaaacttaacgtaaattacncgactacctagtcttagtacgatacgtacgctagaactagacaacgtaagactagaacgtaccgaaactccgtacgttcccagtcgacgacgtccgttaaccgccttggttacggacgtaacccgcggtaaaaggtcgttaaacgtgtttaactaagttaacgtcggtaaacgaccggacccgtaccgtaaanacgtac

SEQ ID NO: 431453 - DNA, 563 bp, Homo sapiens
  misc_feature: GZ8MTXP02I2HY6.19.71.G05.1.454.CMB.2.raw
  modified_base (306)..(306): a, c, t, g, unknown or other
  modified_base (315)..(315): a, c, t, g, unknown or other
  modified_base (339)..(339): a, c, t, g, unknown or other
  modified_base (357)..(357): a, c, t, g, unknown or other
  modified_base (378)..(378): a, c, t, g, unknown or other
  modified_base (425)..(425): a, c, t, g, unknown or other
  modified_base (438)..(438): a, c, t, g, unknown or other
  modified_base (449)..(449): a, c, t, g, unknown or other
  modified_base (559)..(559): a, c, t, g, unknown or other
  modified_base (561)..(563): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgacaagtccagccacaatctttatacagttccaacaatagaaaactacttagcttggtaccagcagagaccaggacagcctcctaggctgctcatttactggcatccgtacccgggatccggggtccctgacccgattcagtggctaggcgggtctgggacagatttcactcncaccatcancgacgtcctgcgaggactgaaatntggtagaccgttagtttnttattacgtacaactaagttntttatagttacttcgtgtacgtcggactaagggctaaagtgattaanacagacgtagtgngctcacacgtntcttgtcttactaccttcccgtacccactcgtacgacgaaacgacggtaacgtacggtacggtacggacgggtcggacggtacggtacggacggacgaacgagtagacgncnnn

SEQ ID NO: 431454 - DNA, 702 bp, Homo sapiens
  misc_feature: GZ8MTXP02JW27Y.19.71.G05.1.454.CMB.2.raw
  modified_base (652)..(652): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcactgtgccatcgtccgggacacgcgtcgctagcgacagtgttcgcgttggctacgtcgggtacacggtccaccgtccccagtccgggaaggtacggttacgtaagggtagggtcgggtaccggttagggggaaaacggtacgtaacgtttaactttcgaaacgttcggtacccgtaaaaccgtaacgggttaacgggtaaaacttaaaccgtaaaagtttaaccgttacggaccctaaaccgttattaccggttagggtttaggaacggtaacggtaccggaacttaacggaaacctaaacgttaccaaaagggttacaaactaacagttaccgaaaacggtacctacgtttcccacccgtgaccagtccgtacgtacctcgtagtaccgacccggtaccggtaacggacgtacggggttnttaagtaacggttacgttaaggacggtaaacgccggttacccaagtaacg

SEQ ID NO: 431455 - DNA, 599 bp, Homo sapiens
  misc_feature: GZ8MTXP02GJHQH.19.71.G05.1.454.CMB.2.raw
  modified_base (495)..(495): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctccacaaggtgtcctgtcacaagtacagctgcagcagtcaggtccaggactggtgaagccctgcagaccctctcgctcacctgtcgccatcgtccggggacagagtcgctagcgacagtgtgcttggcacgtggtcaggcagtccccatcgagaggtcagagtggcgtagggaagcatattcatcgtacaacacgtaggaactaacgaaattatacgacctaaccattccgtgttaggagtagtacgatagactaaatacaaacgtagaacactacgtacgaaacgaacctacgtttaccaccccgtaggacctagtacctacgtaccctctaggtaccaaccgtacccggagggaccgtaacggggtntaagttaactacggttaggtaggtaaacgaccggtaccccgtaagaacgactaacgtccgaacctaaccgttcgtaccgtcgtacggtacgttacgttaaacgg

SEQ ID NO: 431456 - DNA, 559 bp, Homo sapiens
  misc_feature: GZ8MTXP02FF941.19.71.G05.1.454.CMB.2.raw
  modified_base (221)..(221): a, c, t, g, unknown or other
  modified_base (313)..(313): a, c, t, g, unknown or other
  modified_base (319)..(319): a, c, t, g, unknown or other
  modified_base (330)..(330): a, c, t, g, unknown or other
  modified_base (387)..(387): a, c, t, g, unknown or other
  modified_base (436)..(436): a, c, t, g, unknown or other
  modified_base (443)..(443): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacagtacagctgcagcagtcaggtccaggactggtgacgccctgcagaccctntcgctcacctgtcgccatcgtcggggacagagtcgctagcgacagttgtgcttggcacgtgggtcaggcacgtccccagtcgagagtctagngtcggntaggggaaganatacgtttcatcgtcccaaacacggtaggaaattacaaatttaagtcacctaaccgntttactaggttacgagtaacgtcgtaactggaacctaatccgaaacganactaacntacgaacgaactcgttcacctgcagctcgactcgtgtacgtaccgaccgacggtacgtaccggtagttacgtaacgtacgtacggttacggtaacggaccgacccgacgtaaacgg

SEQ ID NO: 431457 - DNA, 667 bp, Homo sapiens
  misc_feature: GZ8MTXP02FKUSX.19.71.G05.1.454.CMB.2.raw
  modified_base (318)..(318): a, c, t, g, unknown or other
  modified_base (394)..(394): a, c, t, g, unknown or other
  modified_base (468)..(468): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccactcgtccggggacagagtcgctagcgactagtgttgcgttggcacgtgggtcaggcacgtccccagcgagaggtntacgagtggcgtaggggaagactagttatttcattacgtaccaaacgacgttaggaaaattaacgtaaaatttacnggactaaccctattccagttacgagtaaggtacggtactaacgtacaaaactactaaacgtaaccgggtaaaanaacctaaacgtaacgtaaacgtaaaccgtaaccgttaccgttaccctacggacctacgaccgtacgttaccgtaccgttacggtaccggtaaccgtaccccgggtaaaccgggtaccgggtaacgggttacggtttaataaacgtttacggtaacggtaacgggaaccgggtaaaccggtacccccggtaacgtaacgg

SEQ ID NO: 431458 - DNA, 740 bp, Homo sapiens
  misc_feature: GZ8MTXP02HXC2A.19.71.G05.1.454.CMB.2.raw
  modified_base (226)..(226): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtagaacgccctgacacgacccctntcgcctcaccgttgtcgccacgtccgtccggggacagacgtcgacgtagccggacaggttgttcggacgtttgggaccgtaacggttcgggggtaccacggggtaccctaccggttacccccgaagttcccgggtaaaggtaacgggttaccgtaaagggtaacggttcggggaccggttagggggaaaacgtaaccgtagtttacggtttttacaacggttcggttaccccgaaacgaaacggtttacggaaaactttaaacctaaaagtttagtacggaacctaacccgtaatcgttaggtttaggaacgttacggtacggtaaactaggtaaaccaaactaccgtaaaacggttacgaaacaccggtaacttaaaccgaaaacgtaacccgtaacgttccctacccgtacgacaccgtctacggtaacctcgtacgtcgaaaccgtccggaacgtacgtacgggtattacgtaacgttactaggtacgaaaacgccggtacccataaccgg

SEQ ID NO: 431459 - DNA, 668 bp, Homo sapiens
  misc_feature: GZ8MTXP02HACUT.19.71.G05.1.454.CMB.2.raw
  modified_base (344)..(344): a, c, t, g, unknown or other
  modified_base (410)..(410): a, c, t, g, unknown or other
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtcgtcctgtcacaagtacagctgcagcagtcacggtccaggactgggtacgaacgccctcgcacgaccctcgtcgctcaccgtgtcgcctagtccgtccggggacaggacgtcgcgtacgcgacgtagttcgttcgcgttggctacggtgggtcaggccacgtccccatcggagtaggtctaaggnggtggacgtaggggaaagactattattcatcgtaccaaagtacggtaggaaataacgtaaatttancgaccactatcgtagttagagtagtacgatagaaactaatacgaaaacggtacaaccaacgtaacgtaacgaaaacgtaacctaacgtttcccacccgtagaccgagtaccgtacgtacccttcgtacgggtaccgtaacccgttacccgggaaagggtaccccggttaacggggttactttaaaagttaaccgtttacggtacggggttaaaacggggaaaaccggaccccggttaacccccgaaaagttaacccgg

SEQ ID NO: 431460 - DNA, 690 bp, Homo sapiens
  misc_feature: GZ8MTXP02FGVEF.19.71.G05.1.454.CMB.2.raw
  modified_base (247)..(247): a, c, t, g, unknown or other
  modified_base (298)..(298): a, c, t, g, unknown or other
  modified_base (323)..(323): a, c, t, g, unknown or other
  modified_base (358)..(358): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtcgcccgacggggacatcgtgatgacccagtctccagactccctggctgtgtctcgtgggcgaggcgggccaccgatcaactgacaagtccagccaacaatcttttanacagtccaaacatagaaaactctagcttggaccagcagacgaccaggaacncgcctctaggctagctacattacgnggcacgtcgtaacccgggagtcccccggggtcccngaccgtattcgagtcggcagggccgggtcgtagggacaggtacttcactcctacacaatcagcacgccctgcgacggctaggaaagtagtggtacggtactttaaagggttttaactttagtttaacggttaaccctaaaaacgtttaaattaaaagttttaaacttttaagtttaaaaccggttttccgggttaacggggttaaaaccccgggtttaccggggaaaccccggttaaaacggggaaacccggttaaaacggggtcggtaaaatttaaccggacgttaaaacggaaaaccgtaaaccggtttagggtccggaccggttaaccg

SEQ ID NO: 431461 - DNA, 634 bp, Homo sapiens
  misc_feature: GZ8MTXP02GEHVT.19.71.G05.1.454.CMB.2.raw
  modified_base (238)..(238): a, c, t, g, unknown or other
  modified_base (395)..(395): a, c, t, g, unknown or other
  modified_base (443)..(443): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccagggactggtgaacgccctcgcacgaccctctcgctcacctgcnccagtccgtccgggacagagtcgctagcgacagttgtgtcgttaggcacgtgggtacgaggcctacgtccccagtcggaggtaggtacgtaggtaggtggcggtaggggaacggtactattattcagtcgtaccacgacggtagaaataactaatangacactatcgtagtagagtacgtacactagaactagtaacgaagtaanactaacacgtaacgtaaacaaccgttacgttaccctacccgataaccgacgtccttaccgtacccttcgtacggtcccgtaaaccggtaccccgggaaagggtacccgtaagggggttacctttaagttaacgttaaccggtagggtaacggaaaccggtacccggaacccctaaggttaaccgaaaccgg

SEQ ID NO: 431462 - DNA, 685 bp, Homo sapiens
  misc_feature: GZ8MTXP02H6DII.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggctggcgaacgccctcgcacgcccctctcgctcactgcgccacgtccgccggggacaggtacgtcgcgtacgcgacgtggttgttcgtcgttcggctacggtcgggtcgaggccacgtccccagtcggaggtacggtcgtacgggaggtcgggtaccggtaggggaaacgtactaatttacttactacgttccgtaccgaaagtacgtaggtaaaacttaaacgtaaatttaacgtacaccctaactcttcgtaggttagacgtacgtacgtaacgtacgaacaacgttaccgaaagtaacgaacactaacgtaacgaaactaaccgtacgttcccgtacgtcgaccgacgtacgtactcccgtttacgacgtaccggacccggttacccgggaaaccggggttaccgtaaacgggggtttacttaaaccgttaagttaccggttaggggacccggtaaacggtaccccgaacccgtttaaagaaccgg

SEQ ID NO: 431463 - DNA, 521 bp, Homo sapiens
  misc_feature: GZ8MTXP02FEXCH.19.71.G05.1.454.CMB.2.raw
  modified_base (199)..(199): a, c, t, g, unknown or other
  modified_base (316)..(316): a, c, t, g, unknown or other
  modified_base (337)..(337): a, c, t, g, unknown or other
  modified_base (471)..(471): a, c, t, g, unknown or other
  modified_base (515)..(515): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctntcgctcacctgtgccatctccggggacagagtcgctagcgacagtgttgcttggcactgggtcaggcagtccccatcgagaggtctagagtggctggggaagcatattcatgtcaanacgttaggaactacaaaattntgctaccattcagttgagtacgtcgactgaccaaatcaaacgtagacacaatacgaaagtaaccaagttctcccagccagctacgactctagtcgactcccgaaggacgtacggtagtattataactggagganaacggccccaagtacgacaacgtgaacccactcgtctcttaggncttaag

SEQ ID NO: 431464 - DNA, 596 bp, Homo sapiens
  misc_feature: GZ8MTXP02I9IB2.19.71.G05.1.454.CMB.2.raw
  modified_base (162)..(162): a, c, t, g, unknown or other
  modified_base (239)..(239): a, c, t, g, unknown or other
  modified_base (252)..(252): a, c, t, g, unknown or other
  modified_base (258)..(260): a, c, t, g, unknown or other
  modified_base (270)..(270): a, c, t, g, unknown or other
  modified_base (275)..(275): a, c, t, g, unknown or other
  modified_base (296)..(296): a, c, t, g, unknown or other
  modified_base (483)..(483): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtntcctgtcaacaagtacagctgcagcagtcaggtccaggactggtgaacgccctgcacgaccctctcgctcactgtcnccatccgcggganagctcnnncgatgtgtgntgacngtggtcagcacgtccagtcgngtcgtctaggagtggcgtagggaacgtactatttagtttcgaacttcggtacccaaagtaccggttaagtaaactaaacgttaagtatcccggaaactacgtagtcgttagtagcgtaattccggaacttagaacaacgtacaaacgtagaaccacgttagactaaacgtactaccgtcctacccgngactcgtactcgtactcgtacgtaccgaccgtaccggtaaacggtcggttacgtactttaaggttaaccgttacggtaacgggtaccggaacgtacccgtaccgtaaagtacg

SEQ ID NO: 431465 - DNA, 589 bp, Homo sapiens
  misc_feature: GZ8MTXP02HTX0I.19.71.G05.1.454.CMB.2.raw
  modified_base (288)..(288): a, c, t, g, unknown or other
  modified_base (345)..(345): a, c, t, g, unknown or other
  modified_base (402)..(402): a, c, t, g, unknown or other
  modified_base (435)..(435): a, c, t, g, unknown or other
  modified_base (449)..(449): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagtgtgcttgcacgtggtcaggcacgtccccatcgagaggtctagnggtgcgtaggaagacattactttcgatcgtacaacgacgtaggaactaactaaattnacgacacctatcgtagttacagtacgtacgactagtaacaatacgaaacgtagacanaagtacgaaacgaacctagttccaccctagacnggtactcgtactcnggttacacccgtaccgaggtaacgtacgggttataacttacgttaacgttgggaacggaaacggacccgtacccctaaaggtacgaacacgttacgaaccccttacgtcgttcctaccggttagtactacgtttaaacgg

SEQ ID NO: 431466 - DNA, 650 bp, Homo sapiens
  misc_feature: GZ8MTXP02GW1W5.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgcctcaccgtgtcgccatcgtccggggacagagtcgcgtagcgacagtgtgcttggcacgtgggtcgaggcacgtccccagtccggagtacggtctagaggtggcgtacggggaagacgtatacgtttcattcgtaccaaacgaacgtagaaaacttaacgtaaaatttactagaacctacctaaagttccgttagttaggaacggtagtaccgtaacgtaacggtaaacaaacttaccgtaaaacggtaacgaaacctaaacgtaacgtaaaccggtaaaacgtaaaccccgttaaacgttacccttaccccgttaggaccctaggtacccgtacggtaacccttcgtacgacgtacccgaccggtacggtacgtacgggtattagtaagttacgtacgtacggacgacgacccaagtaacg

SEQ ID NO: 431467 - DNA, 659 bp, Homo sapiens
  misc_feature: GZ8MTXP02JVHU9.19.71.G05.1.454.CMB.2.raw
  modified_base (252)..(252): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtgaacgccctgcagaccctctcgctcacctgtcgccatcgtcccgggganagagtcgctagcgacagtgtgcttggcacgtggtcaggctagtccccagtcgagtacggtctaggagtggacttaggggaacggtactagttaactttcgaagttcgttacccgaaacgtaccggttagggaaaacttacctaaaatttacgtacgtaaccgtaacccgtaacttaccgttaggttacggtaagtacgtaccgtaacgtactaaccgggggggtaaactaacgtaaaacggttaacgtaaacgaacctaacgttaacgaaacggtaaaccgtaacggttaccctaccgttacgtacgacgtacgtacgtacctacgtcgtacgtaccgtaccggacggtacgtacggtacgtacgtaacgttacgtacgttacggaacgtacggacccgacgtaacg

SEQ ID NO: 431468 - DNA, 625 bp, Homo sapiens
  misc_feature: GZ8MTXP02GOX35.19.71.G05.1.454.CMB.2.raw
  modified_base (273)..(273): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctccacctgtcgccacgtcgtccggggacagacgtcgctagcgacngttgtgcttggcacgtgggtcaggcacgtccccagtcggagaggtcgtaggagtggcgtaggggaacgactattactttcgacttcgtaccaaacgtacggtaggtaaaacttaacgtaaaatttatacgacctacctattacgtaggttacgaagtacgtaccgacgtacgaaactaactaacgaaacgtagaaacgacaacgtacgaaacgaacctacgttccctaccgtagctacgtacgtacgtaccctacgtcggtacgacccgtaccggaacggtaccggtaacgggttattaacgttaacgttacggttaggtacggaaacggtaccggacccctaagtaaaccg

SEQ ID NO: 431469 - DNA, 600 bp, Homo sapiens
  misc_feature: GZ8MTXP02FWPET.19.71.G05.1.454.CMB.2.raw
  modified_base (236)..(236): a, c, t, g, unknown or other
  modified_base (311)..(311): a, c, t, g, unknown or other
  modified_base (347)..(347): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaactacttagcttggtaccagacagagaccagacagcctcaggctgctctattacngggcatcgtaaccggagtcccgggtccacgaccgtntcgagtgacaggcgggtctcgggactagatttcgactctacacgatcaagcacgcgtcgccgagggtctagaacgagttggtaggtacgttagttttaatagttacgtaaacctaaattaattaattttaaattcttaacggttacgttacgggaccgtttacgggaccgtaaaacggggtaaccgttaaagggtggtaaacgtataaccgtaaggacgttaaacgtggtacggacgttacggacctaaaccg

SEQ ID NO: 431470 - DNA, 815 bp, Homo sapiens
  misc_feature: GZ8MTXP02G9I8V.19.71.G05.1.454.CMB.2.raw
  modified_base (282)..(282): a, c, t, g, unknown or other
  modified_base (809)..(809): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggtactggtagaacgccctcgcacgaccctctcgcctcaccgtgtcgcctacgtcgtaccggggacagacgtcgcgtacgcgaacnggttgtcgtcgttggcctaacggtcggggtcacggcctaaccggtccccaagttccgggacggtaggttccgtaaggtaggtacggggtacgtaagggggaaagtaaccgttaagtttacgtttacgaacgttaccggttacccgaaaacggtaaccggtttaagggtaaaaacctttaaaaccggttaaaaactttacggttaaccggaacccttaaacgttaaccggtttaacgttttcggggtttaaggaaaggggtttaacgtacccgttaaacgttaaacggaaaacctaaaaacgttcccgaaaaaacgggttaaccggaaactaaaccgtaaaaccgtaccgtaaaaaaccgggtaaccctttaaaccggtttccctacccccgttaaggaaccccgtttcgacgtttaacccgaccccgtttaaggtcgtaaaccgtacccgtacccggggaaggtacggtaaccgggtttataattaacggttaacggttcggaaggtaaccgaccccgaccgttaanaaccgg

SEQ ID NO: 431471 - DNA, 740 bp, Homo sapiens
  misc_feature: GZ8MTXP02JM2KT.19.71.G05.1.454.CMB.2.raw
  modified_base (230)..(230): a, c, t, g, unknown or other
  modified_base (240)..(240): a, c, t, g, unknown or other
  modified_base (321)..(321): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccanaattctttanactagttaccaacaatagaaaactcttagcttaggtaccagcagacgacaggacagcctacgagctagctactatttacgnggctacgtccgtaacccgggaagttcccggggtacccccttggaaccttacgtcgtaaggtcggaacgtcgggtccggggtttacgcgggggaaccctaagggttacgtttttacccaaacccggttccttacccaaccccggtttaacgtaaccgtacgtacccgtacggtaccgtacggccggtaacggtacgtaacggaaaggtacgttacgggtacggttaacgtttaacggttttacttaaacgttacgtaaaaccttaaaacttaagtttaactttaactttaacgtttaccggttacggttaacgggtacggttaccggaaaccggtaaacgggttaaccggttaacgggtacgtaaacgtaacgtaaccgtaaggtaaaccgttacggtacgttaccggtacgtacgtaac

SEQ ID NO: 431472 - DNA, 610 bp, Homo sapiens
  misc_feature: GZ8MTXP02I1N92.19.71.G05.1.454.CMB.2.raw
  modified_base (299)..(299): a, c, t, g, unknown or other
  modified_base (303)..(303): a, c, t, g, unknown or other
  modified_base (311)..(311): a, c, t, g, unknown or other
  modified_base (319)..(319): a, c, t, g, unknown or other
  modified_base (509)..(509): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgcctccaccgtgtcgcccatcgtccggggacaggagtcgctagcgacgagtgttgcgttggcacgtggtcnggcncgtccccngtcgaggngtctagagtggcgtaggggaacgactagttagtttccagttcgtaccaaaccgtacggttaggaaaattaactaaattacgtcgacctaacctattcgtaggttagacgtagtccgtaagtcgaaacaacgtacgtaaacgtaaggacctaacgagtaaaccgaacgtaaaccctacgttccttacccgngacctcgtacgtcgtaccttcgtgaccgccgtaccggaaggtaccgtaacggttgttaaactcgtttcgaaggtacggaactacccggaccctagtaaccg

SEQ ID NO: 431473 - DNA, 656 bp, Homo sapiens
  misc_feature: GZ8MTXP02HAGKV.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtacgaacgccctcgcacgaccctctcgctcacctgtcgccatccgtaccggggacacggacgtccgctacggcgacgtaggttgttgtcgttggctacgtgggtcaggccacgtccccagtcggagacgtcgaggaggtggcgtaggggaacgatagttacttcgatcgtaccacgtacgtaggaaactaaactaaattacacgaccactattcgttagtaggagtacgtacgacgttagaactaataccgaacgtaacaacctaacgaacgtacgaaaacgtaccttacggtttccctacccgtaggacctacgtaccgttaccgtaacccgttcgttacggtacccggtaccgttaaccccggggaaggtaaccggtacggggttaatttaacgttaacgttaacggtacggtaaccgggaaacgaaccccgtacccgtaaagtacgtaaccg

SEQ ID NO: 431474 - DNA, 576 bp, Homo sapiens
  misc_feature: GZ8MTXP02JNJ5J.19.71.G05.1.454.CMB.2.raw
  modified_base (238)..(238): a, c, t, g, unknown or other
  modified_base (313)..(313): a, c, t, g, unknown or other
  modified_base (373)..(373): a, c, t, g, unknown or other
  modified_base (400)..(400): a, c, t, g, unknown or other
  modified_base (416)..(416): a, c, t, g, unknown or other
  modified_base (431)..(431): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactactagcttggaccagcagagaccaggacagcctcctaggctgctcatttacgngggctagtcctaccgggattccggggtacccctgaccgtattcaggtcgcacggcgggtntcggggacaggtactttcaccgttccncaccatcagcacgccngacgagactagaagngtggtagtatagtttactagttacgtactaaactaattattaattacgttacgttacgtacggtaccgttacggaaccgtaacgggaacgtaagggtacgtaactacgtaacgaacgtaacgtacgttagtacggtactacgtac

SEQ ID NO: 431475 - DNA, 741 bp, Homo sapiens
  misc_feature: GZ8MTXP02JT45Y.19.71.G05.1.454.CMB.2.raw
  modified_base (244)..(244): a, c, t, g, unknown or other
  modified_base (480)..(480): a, c, t, g, unknown or other
  modified_base (502)..(502): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtggcgagcgggccaccatacaactgacaagtccagccaacaattcttttaanactagttacccaataatacgaaaacttacttagcttaggtacccagacgaagacgacgaacggtacaccgtccctacgtacggctcgtcctacttaactttcggacggacttacgtacccggtaaacccggggtcggttccccggggtacccctacgaccgttatacggtaggtcgacggacgggtccgggttagtacgggaccgtagttactttaccacctttcacccgacctanacgacgcgtacgccgacgacgngtacgtaagtaggtgttacgggtacgttaattaagttttaacgttacgttaacgtaaaacttaaaatttaacttttaactttaacgtttaacgtttacggttccggggttaaacgggttaaccggttaaccgggtaaaaccgggtaaaccggggttaaacgtaacggggttaactaaagttaaacgtaacgggtaaaacggttaaccgtacgggttcggaccggttacgtaaccgtacc

SEQ ID NO: 431476 - DNA, 640 bp, Homo sapiens
  misc_feature: GZ8MTXP02ISNAZ.19.71.G05.1.454.CMB.2.raw
  modified_base (545)..(545): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgacacgacccctcttcgcctcacctgtacgcctagtccgtaccggggacaggacgtcgctacggccgtaacgaggttcgttgccttcggcacgtgggtcaggtcacgtccccagtccgagtacgttccgtagaggtggacgttagggaaacgactagttactttcgagttacgtaccgaaacgtaccggtagtaaattacctaaaagtttatcgacctaaccagtttctaggttagaaacgtaggttaccgaacttaacgaaccttaaagccgtaaaacggtactaaaccaacgaagttaaccgaaacgaacccctagttacccttaccgngaccgacgtaccgtacgtacccgtgtcgtaccgtaccgtaccggacgacggttacgttatactcgtacgtacggacgacgacctaccgtaatacg

SEQ ID NO: 431477 - DNA, 686 bp, Homo sapiens
  misc_feature: GZ8MTXP02FFVP1.19.71.G05.1.454.CMB.2.raw
tcagtactctcgtgcacgaccggtgctcgatttagtgtcgtcgcaagagagagggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggctacgtgggtcaggcacgtccccatcgagaggtctagagtggctggggaaggactagtatttcagttcgtccaaacgacgtaggaaactaacgtaaatatagcaccattctggttagagtagtcgaactgaactaaactacaaacgtagaacacaataccgaaagtaacctaacgtttcctacccgtcggaccacggtcctacgtaccccttcgttacgggttaccggtaccccgttacccccggggaacgggtaaccggtaacgggggttaacgttaactttaaacgtttaaacgttaggggtaacggggttaaaacggtaaccccggggaaccccccctaaagttaacggaaaccctaagttcccggaaccccgtaaccccgtttccggtacccgttccgtttacggggtactacgttttaaaacgg

SEQ ID NO: 431478 - DNA, 629 bp, Homo sapiens
  misc_feature: GZ8MTXP02FOCPR.19.71.G05.1.454.CMB.2.raw
  modified_base (244)..(244): a, c, t, g, unknown or other
  modified_base (249)..(249): a, c, t, g, unknown or other
  modified_base (297)..(297): a, c, t, g, unknown or other
  modified_base (332)..(332): a, c, t, g, unknown or other
  modified_base (396)..(396): a, c, t, g, unknown or other
  modified_base (429)..(429): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctcccgtggctgtgtctcgtgggcgaggccggcctaccgatacgaactgacagtccagccataacttntttanactagttaccaaataatagaaaactcttagcttaggaccagacaaganaccaaggtacagcctacgagctagctatatttcgnggctatcccgtacggtacgtcccggtacccctacgaccgtattcgagtcggctaggggtcggtntagggactaagtctttacactctaccacgtacncgacgtccacgtccgtagacgtaggtaacgtaaggacggtagtacggttacgttaatttaacgttttaatacgttaacgtaaactaattaatttaacgtttaagttaccgtttacgttacgggtaccggttacggaccggaaagtaaacggtacgtacgggtacagttacgaagtaacgacggtagtcgagtcgtacacg

SEQ ID NO: 431479 - DNA, 683 bp, Homo sapiens
  misc_feature: GZ8MTXP02HRQ31.19.71.G05.1.454.CMB.2.raw
  modified_base (322)..(322): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtagaacgccctcgcacgaccctctccgctccacctgtcgccagtccgtccggggacagacgtcgcgtacgcgactagttgtgcgttggctacggtggtcaggcacgtccccagtcgaggnggtactagacgtggagtacggggaagactagtttactttcaacgttcgtacccgtaaacgtaccggttaaaggtaaaacttaacgtaaaactttagttacgaacctaaccgtaatttccgtttgttaggagttaacggtacgttaactaacggaaacttaaacgtaccgtaaaactaacgacctaaacgttaacgttaaccgaaaagtaaccccgtaaccgtttcccgtaccctagactaccgtactcgtacccgtttagccggttaccgaccgttacccggaaggtacccgtaaggttaacgttaagtaacgtttacgtaacgggttacggaaaccgtccggaacccctaagtaaacccg

SEQ ID NO: 431480 - DNA, 676 bp, Homo sapiens
  misc_feature: GZ8MTXP02IYOOD.19.71.G05.1.454.CMB.2.raw
  modified_base (314)..(314): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgcccctgcacgaccctctcgctcacctgtcgccagtccgtccggggacagacgtcgctagcgactagtcgttgcgttggcagtggtcaggcacgtcccagtcgagngtcagtagtggcgtagggaagactagttactttcgacgttcgtaccgaaacgtaggtaacgtaaacttaacgtaaaagtttacgtcgaaaccctaccttagttccgttagggtagtaaacggtacgtacgtaaacgttagaaccgtaaataccgtaaaaagttacgaaacctaacgtaacgttaacccggaaaagttaaaccccgtacgtttacccctaccgtacggacgtacgtacgtacgtaacccgttcgtacggtacgtacccgttacccgggaaggtacccgtaacggggtttattaaacgtaaccgtttagtacggggtaacgaaaaccgggcccgtaaccccgtaagtaaacccg

SEQ ID NO: 431481 - DNA, 724 bp, Homo sapiens
  misc_feature: GZ8MTXP02F4PHS.19.71.G05.1.454.CMB.2.raw
  modified_base (254)..(254): a, c, t, g, unknown or other
  modified_base (349)..(349): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgaggccgggccaccatacgaacgtgacaacgtccagccaactaattctttanacgtacgttaccaaataagtaacgtaaaactacttaagtcttacggaacccaggaccaagaacgaccgaaggaccaacgtccctccgtaaggccngtccttactaattttaccggcggtacctaaccgtacccggtaacccggggtaaacgttccccggggtaccccccttaggaaccccgttgtaccgaggtcggacgtcggggtccgggtcgtacgggtactaagttactttaccaccttacacctaacccgtctacgacgtccgacgccgtagacgtaggacgtagaagtagtagggtagttactttaagtttacttaagttactaacgttaaattaaattttaattaacgttaacgtttacggttacggtaacgggtaccggttaaccggaaacggtaacgggaacgtaaggttacgtaagttacgaacgtaacggaacgtaacggttcgtacggtacctacgccg

SEQ ID NO: 431482 - DNA, 659 bp, Homo sapiens
  misc_feature: GZ8MTXP02IT35N.19.71.G05.1.454.CMB.2.raw
  modified_base (246)..(246): a, c, t, g, unknown or other
  modified_base (354)..(354): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgaccagtctccagacctcctggctgtgtctcgtgggcgagcgggccaccgatacgactgacaacgtcacgccactaattctttaanacgtaacgttaccaaactaagtacgtaaaaacctcgttagtcttaggtaaccaggacaaggacgacgaacggtacacgtcctacgaggctcgactcgtaactttcggnggacctacgtaccggttaaccgggacgtcccggggttcccctaacgggacccttagtccgtaggttacgggctacgggggtacccgttggacggggtacctaacgttcgttaccctaccttctaaacaccctagtacgacgtacgacgtcacgacgacgacgtagtagtaggtgtagttagttagtttagttatagtaactaataattattattagttacgtacgtacgtacgtacggtaacgtaacggtaacggtacgtacgtagtacgtaacgacgacgtacgtacgtacgtacgtacgtacg

SEQ ID NO: 431483 - DNA, 707 bp, Homo sapiens
  misc_feature: GZ8MTXP02JZQB2.19.71.G05.1.454.CMB.2.raw
  modified_base (229)..(229): a, c, t, g, unknown or other
  modified_base (287)..(287): a, c, t, g, unknown or other
  modified_base (295)..(295): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccgggganagagtcgctagcgacagtgttgcttggcacgtgggtcaggccacgtccccagtcgagnggtctagngtgcgtagggaagcatattcagtcgtaccaacgagtaggtaactaactaattacgagccactatcgtgtaggagtacgtaccgagttacgaactaacgtacgtaaaacggtacgaacctaactaacgtaccgaaaaccgtaaaccgttaccggtttacccctacccgttacgacccgtaaaccggtccggttaccggtaccctttaccggttacgggttaacccgtaacccgttacccgggggaacggttaacccgggtaacggggtttacgttaaacgtttacgtttaacggtacgggttaaacggggaaaccggaccccgggtaaccccctaagggtaaccgtaacgtaaccgtcggtaacccctaccggttccgttccgttaccggttcggtacgttacctttaagggg

SEQ ID NO: 431484 - DNA, 768 bp, Homo sapiens
  misc_feature: GZ8MTXP02JT9UA.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtacgaacgccctcgcacgaccctctcgctcactgtcgcctagtccggtccggggacaggcgtcgcgtacgcgacgtggttgttgtcgtttggctacggttcggggtacgacggtaccgtaccgtcccctaggtaccgggaaggtacggtacgtaagggtacgggtcggggtacggtaaggggaaacggtactaacgtttactttacgaacgttaccgtacccgtaaacgtaacggtaaacggtaaaactaaacgttaaacgtttacgtacggacctaacctacgttacgttagggtagaacggtacgtccgaacgttacggaaactaacgtacgaaaacggttacgaaacctacgtaacgtaaaccggaactaaacccgtacgtttacccgtacccgtaacgtacgacggtacccgttacgtacccgttacggtacggtacccgtaacccggtaccccgggtaaagggtacccggttaacgggggtttattaaaccgttaaccggttaacggtacggggttaaccggggaaacccggtaccccggaacccctaaggttaaacccgg

SEQ ID NO: 431485 - DNA, 723 bp, Homo sapiens
  misc_feature: GZ8MTXP02FNT7K.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccacgtccgtccggggacaggacgtcgcgtagcgacgtaggttgttgtcgttggctacgtgggtcgaggccacgtccccagtcggagtacggtactaggaggtgggacggtacggggaaaggactaagttactttacgacgttacgtacccgaaacgtaaccgggttaaggtaaaacttaaaccgttaaaagtttagtaccggtaaccctaaaccgttagtttaccgtttaggttaggaaaggtacggtaccgtaaccgttaagaaacctaaacttaccggtaaaacggttaaacgaaaccgtaacctaacgttaaaccggaaaacggtaaaccccttacggtttacccctaccccgtagaccgtaacgtccgtacgtacccgtcgttaccggtaccgtaacccgtacccgggacggtacccgtacggggttacttattaacgttacgtaggtaacggaaccgtaccggacccctaagtaaccg

SEQ ID NO: 431486 - DNA, 786 bp, Homo sapiens
  misc_feature: GZ8MTXP02GLJRU.19.71.G05.1.454.CMB.2.raw
  modified_base (343)..(343): a, c, t, g, unknown or other
  modified_base (356)..(356): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccgtggctgtgtctcgtcgggcgacggccggaccaccgataccaacgtcgacaacgtccacgaccctaaactaactttaccttttaagacctaacgttaccaaataaactacgaaaacttacttacggcgttacggaaccagacagaacgaccgacggacacnccgtacaggctcnctacttagttacgcggactacgtacccgtaaccggggacgttccccggggtacccctcggtaccgtaagttacgtaggtaccggcgtaccgggggtccggggttacgacggggtaacctacggtttaaactttcccgaccttaccctacccgaaccgtacgtacgacgtacggaaccgtccgttaacgacccgtaggtacgttaaggaacgttaaggtgggttaaccggttagtttagttttaacggtttaattacgtaaacgtaaacttaatttaagttttaatttacgttacgggtttacggttacgggttaacccggttacgggtaaaccggtaaaaccgggtaccgttaagggggtaacgttaacggtacgttaaccggaacggtaacggttaaaacgtcggtaccggttaacgccggttaacccg

SEQ ID NO: 431487 - DNA, 613 bp, Homo sapiens
  misc_feature: GZ8MTXP02IIKSZ.19.71.G05.1.454.CMB.2.raw
  modified_base (539)..(539): a, c, t, g, unknown or other
  modified_base (589)..(589): a, c, t, g, unknown or other
  modified_base (608)..(612): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaattcttttatactagttaccaacaatagaaaactacttagcttggtaccagcagagaccaggacagcctctaggctgctcatttactggcatcgtacccggaatcccggggtcctgaccgattcagtgcagcggtctggacagatttcactctcaccatcagtcagcctgaccgaggctagaacgtgtggtcgtacctagttttattagttacgtacaaactaagttattttataatttaccgttagttacgggtaacgtttaccgggaacccaaaggggtaaccctaaagggtggtaaattacgtaacccgaagtaacccgtaaagttggtacggactacgaccgtaactattcgtcgttacttctaacttcccgttacccactaccgtnttaccggaacgtacggatacggttacgcgggaggtacccggtgaccgganacggccgtaagacgtagcnnnnng

SEQ ID NO: 431488 - DNA, 785 bp, Homo sapiens
  misc_feature: GZ8MTXP02H1JQ6.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcgaggtccaggactggtagaacgccctcgaccacgaccctctcgctcaccgtgtcgccagtccgtccggggacaggacgtcgtactacggccgaacgtaggttgttcggtcgttcgggcgtaccggttcggggtccgaacgggtaccgtaccggtccccccaagttcccgggaggtacggttaccgttaaggacgggttcgggaccgggttaggggaaaacggtacttaagtttactttacgaacttaccgtacccgaaacgtacgggtaacggtaaaatttaacctaaaagtttacgttagacccttaacgtactttacggtggttacgggtaaaggtacggttaccgtaacgtaacggaaaccttaaacgtaccgtaaaaccggttacgaaacccttaacgaacgttaaccggaaaaccgggtaaaaccctaccgtttaccccgttccgacggtaaccgtagtacccgttacgtacccgtttacggtacgtaccggtaccccgtaccgggaaacggtaccgtaacggggttactttaacgtaacgtttaacggtacgggttacggaaacgttaccccggaaccccgtaagtacccg

SEQ ID NO: 431489 - DNA, 576 bp, Homo sapiens
  misc_feature: GZ8MTXP02JZHWM.19.71.G05.1.454.CMB.2.raw
  modified_base (243)..(243): a, c, t, g, unknown or other
  modified_base (322)..(322): a, c, t, g, unknown or other
  modified_base (417)..(417): a, c, t, g, unknown or other
  modified_base (422)..(422): a, c, t, g, unknown or other
  modified_base (445)..(445): a, c, t, g, unknown or other
  modified_base (455)..(455): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccaccatcaactgcaagtccagccaacaattcttttanactagttaccaacaatagaaaactactagcttggtacccagcagacgaccaggacacgcctctaggctgctcatttcgnggctatccgtacccggggatcccggggtccccctggacctattcgaggtcggctagggcgggtactggggactagtactttcactcctcacctancagcncgcctagcacggactagaaagtntggtacggtnttaaggtttatttattagtacaaattaattattaattattacgttcgtacggttacgttacggaccgaaagggacctaaggtacgaatacgtgaagtacgtaagcggttggaactcggacc

SEQ ID NO: 431490 - DNA, 740 bp, Homo sapiens
  misc_feature: GZ8MTXP02F62ZF.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcacggtccaggactggtgaacgccctcgcacgccctctcgcctcacctgtacgccacgtccgtccggggacagacgtcgctagacgacgtaggtgttgcgtttcggacgcgtgggtacagggacctacgtccccgtaagtccggagggtaacggttcgtaaggacggttcggggacgtaggggaaaacgtacctaatttactttcgaacgttacgttacccgaaacgtaacggtaacggaaaacttaacttaaaagtttagtacgtaacctaacctaacgttcttaagggttaggtaaccgtaggtaccgtaacgttaacggaaacgtaaaaccttacgtaaaaccgttacgaaaccgtaaccgtaacgtaaaccgaaaaacgggtaacccttaaccgggtttaccctcccttacgaaccggtaccgtacccttaacgtccgtttaccgtaggttaccctaacccggttacccggaaggtaaccgtacgggttaacgttaagtaacgttaacgtacggtaaacggtaccgaccggtaccccaaaggtaaccg

SEQ ID NO: 431491 - DNA, 508 bp, Homo sapiens
  misc_feature: GZ8MTXP02FHVMW.19.71.G05.1.454.CMB.2.raw
  modified_base (382)..(382): a, c, t, g, unknown or other
  modified_base (390)..(390): a, c, t, g, unknown or other
  modified_base (476)..(476): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgtgaagccctcgcagaccctctcgctcacctgtgccatctccggggacagagtcgctagcgacagtgttgcttggcactgggtcaggcagtccccatcgagaggtctagagtggctggggaagcatattcatgtccaatcgtgaactacaaattgtagcaccattcctgttagagtagtcgactgacaatacaaacgtagacanatacgaanaaccagttctcctgccagctgacctctgtgacctcccgagacgacggtagtatattaacgtgtaggaagacggccccagtacgacnctcgccacgtctcgtacgtcggtacgtactag

SEQ ID NO: 431492 - DNA, 673 bp, Homo sapiens
  misc_feature: GZ8MTXP02JOOEO.19.71.G05.1.454.CMB.2.raw
  modified_base (247)..(247): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgaggggacatcgtgatcgacccagtctccagacctccctggctgtgtctcgtgggcgaggcggccacgactacgaactgacaagtccagaccactaattctttanaccagttaccaaactaatacgtaaactacttagacttacggtaaccagacaagacgaccaaggacacgcctacctaggctacgcttacgtatttaccgtgggaccttacgtaccccggtaaccccggggaaacgttccccggggttacccccctaggacccggttattacgacgggttcggacgtacggggtcgggtacgtacggggaacaggttactttccgaacttccacctaaccacgtacaggaccacgtccacgacgagggactaggagtagtggtaggtacttagtttatagttacgactaaagtattattaagttactacgttacggttacggtaccgttaggacccgtaaagggtaccgtaacgggtaggttaacaggtaaccgaaaggtaactaacggttgtcggaaacctcgaacc

SEQ ID NO: 431493 - DNA, 652 bp, Homo sapiens
  misc_feature: GZ8MTXP02ITCP5.19.71.G05.1.454.CMB.2.raw
  modified_base (226)..(226): a, c, t, g, unknown or other
  modified_base (235)..(235): a, c, t, g, unknown or other
  modified_base (257)..(257): a, c, t, g, unknown or other
  modified_base (260)..(260): a, c, t, g, unknown or other
  modified_base (310)..(310): a, c, t, g, unknown or other
  modified_base (352)..(352): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacattactgcaagtcagccanaatctttanacagttccaacaatgaaaactntancttgtacagcagagacaggacagcctaccgtaggctgacctctatttcgngggtcatccgtaacccggggatcccggggtccctagacccgnttaccgaggtcggaccaggcggggttcctgggggacctagtagtttccactccttcacctatccgaagcctaacgcccgtaggaccaggggtcctagggaaagacgttggtccggggattaaggttttatttagtttacggaaccaaacgttaaattacttttaaacttagtttaaaccgtttcgtaacgggttaaccgttacgtaaacggaccgtaaaacgggggtaccctaaagggttaccggaatttaacgtcgaaaacgttaacgggaaacttgggtaaccggtctacggtaaccg

SEQ ID NO: 431494 - DNA, 650 bp, Homo sapiens
  misc_feature: GZ8MTXP02FO0UG.19.71.G05.1.454.CMB.2.raw
  modified_base (379)..(379): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctctcgctcacctgtgcctagtccgtccggggacaggacgtcgctagcgacagtgtgcttggctacgtgggtcaggcacgtccccagtcgagcgtctagagtggacgtagggaagactatatttcatcgtaccagacgtagaaactaacgaaatttacgngacctaacctattcgttagttacgaagtacgttacgacttagaaacgtaataccgtaaacgtaacgaaaccaacgtaacgtaaccgaaaacggtaaacctacgtttaaccccgtccgttacggacctacgtaccgtacgtaacccgttcggttacggttaccgaacccggttaccccggaaagggtaaccggttaaccggggttataacgtttaagttaaccggtagggtaacggaaaccgtacccggaacccctaaggttacggaaaccg

SEQ ID NO: 431495 - DNA, 747 bp, Homo sapiens
  misc_feature: GZ8MTXP02JTNZL.19.71.G05.1.454.CMB.2.raw
  modified_base (481)..(481): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtacgaacgccctcgcacgaccctctccgctccacctgtacgcctacgtccggtccggggaacaggacggtccgactaggccgactaggttcgttcggtcgttcggccgtacggttcggggtaccgagggtaccctacccggttccccgaaggtcgggaaagggtacggtacgtagggacggggtacgggcggttaaggggaaaccggtacttagtttacgttactagttaccggaacctacggtacggtaagtaaactaaacgtaattcgtacactaccgtnttacgtggttacgagtacgtacgacttagaactaaagtactaacgtaaagcaaacgtacgtaaagggaacctaaccggttcgttaccctcccgtaggaccctacgtaccgttacgtacccttacggtacgggtacccgaacccggtaccggggtaaagggaaccggtttaacgggggtacctttaaaggtttaccgtaaggggttacccggggtaaaagggggtaaccccgaccccgggtaacccgttaaggtaacccgtaaccgg

SEQ ID NO: 431496 - DNA, 528 bp, Homo sapiens
  misc_feature: GZ8MTXP02H5UA4.19.71.G05.1.454.CMB.2.raw
  modified_base (298)..(298): a, c, t, g, unknown or other
  modified_base (311)..(311): a, c, t, g, unknown or other
  modified_base (372)..(372): a, c, t, g, unknown or other
  modified_base (445)..(445): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctgcagacccctctcgctcgacctgtcgcccatcgtccggggacagacgtcgctagcgacagtgttcgcttggcacgtggtcaggcngtccccatcgagngtcagagtggctgggaagacagtatttcatcgtccaatacgtgaaatacaatatgcacctntcgtgtagagtagtcgactagaactactacaaacgtcgaacactagacgaacgactacgtcctacgtagtacncgtacgtactactcgtcgacgtaccgacgacgtacgtacgtatacgtaacgtacgtacggacgaccggaccgtacgaacgtcg

SEQ ID NO: 431497 - DNA, 630 bp, Homo sapiens
  misc_feature: GZ8MTXP02FPFUR.19.71.G05.1.454.CMB.2.raw
  modified_base (238)..(238): a, c, t, g, unknown or other
  modified_base (318)..(318): a, c, t, g, unknown or other
  modified_base (383)..(383): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacatcaactgacaagtccagccacaattctttanacagttcccaacaatagaaaactacttagcttaggaccagcaagagaccaggacacgcctctaggctgctctatttacgngggcacgtccgtaacccgggatccccggggtcctcgaccgtatcgaggtggcgaggccgggtcgngggacagtactttccactcctaccaacctataccagccacgccctgacgacgggctaggaacgtagtggtacggacgttagttttatttaagttgtaacctaaactaatttaatttacttagttaccgtttcggtacgggaaccgtttccgggaccgtaaacggggtaacccgtaagggttacggtaacgtaacgtacgaaacggtaaccggtaaacgttcgggtacggcttacggacctaaacccg

SEQ ID NO: 431498 - DNA, 555 bp, Homo sapiens
  misc_feature: GZ8MTXP02HFW3M.19.71.G05.1.454.CMB.2.raw
  modified_base (301)..(301): a, c, t, g, unknown or other
  modified_base (325)..(325): a, c, t, g, unknown or other
  modified_base (334)..(334): a, c, t, g, unknown or other
  modified_base (381)..(381): a, c, t, g, unknown or other
  modified_base (398)..(398): a, c, t, g, unknown or other
  modified_base (403)..(403): a, c, t, g, unknown or other
  modified_base (410)..(410): a, c, t, g, unknown or other
  modified_base (418)..(418): a, c, t, g, unknown or other
  modified_base (422)..(422): a, c, t, g, unknown or other
  modified_base (429)..(429): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtcctccagacctccctggctgtgtctcgtgggcgaggccgggccacagtacaactgacaatccaagaccaataattacttttaacacgtacgttaccaaataagtataaaactctagcttacggacagacaaganaccaggactcgaccttcagctagntcatttacncggacataccgaccggtaatccgggtaccacgtaccattcagtgacnggcgtcgaggactagtnttacnctaactnaacctaanacanacacacncgacgagagagagagtgtgtagtattattatagtaactaataataattatatacgttagtacgtacgtacgacgacggaacgtagacgagtacgaacgaacgtaacgtacgtagtacgacgacacg

SEQ ID NO: 431499 - DNA, 723 bp, Homo sapiens
  misc_feature: GZ8MTXP02GRUOD.19.71.G05.1.454.CMB.2.raw
  modified_base (239)..(239): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccacaatctttanacagttaccaaacaatagaaaactactagcttaggtaccagcagagaccaggacacgcctccaggctgctactatttacgtgggacctacgtaccgtaacccggggaagtcccggggtaccccctagaccgtacttcgagtcggacgagggtcggggtcgtacgggggaccaaggttactttaccacttcctaaccgtaacccaatccgaaacggcccaacggtccctcgacgacgggtacctaaggaaaggtacgttgggtagggtacttaaagggtttttaatttacgttacgttaaaccaaaattaaatttaaattttaaacggtttaaactttaccgttttaaccgggttaggggttaaaccccgtttaggggaaaccccgttaaaacgggggtacccgtaaaaacgggggttacgtaaagttaacgtaaccggtaaagtaaaccggtaaacgttcgggtacgggtctaacggtaacccg

SEQ ID NO: 431500 - DNA, 739 bp, Homo sapiens
  misc_feature: GZ8MTXP02GM6Y7.19.71.G05.1.454.CMB.2.raw
  modified_base (243)..(243): a, c, t, g, unknown or other
  modified_base (260)..(260): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgaactgacaagtccagccactaatcttttanacagttaccaacaatanaaaactacttagcttacggtaaccagcaagagacccaaggacagcctctaggccttgctcgatttacgtgggacatccgtaaccccgggaaagttccccggggtccccctagacccgtagttccaggttcggaccgagggtccggggttactgggggaccagttacgtttcaaacctcttccaacctaacttcgaaaccgacgacgccgtagacgacggacgtacggaaagtagtaggttacgggttacgtttaagttttaacgttttaacgtttaacgttaaacgttaaaacttaaaactttaaacgttttaaacttttaacgttttaacgtttaaccggtttacgggttaaccgggtttaaaccggggttaaaccgggtaaaaccggggtaaaccgggtaaacgggtaacggttaacgttaacgttaacgtaaaccggtaaacggtaaccggtacggttacggtacgtacgtaaccg

SEQ ID NO: 431501 - DNA, 738 bp, Homo sapiens
  misc_feature: GZ8MTXP02FWKYW.19.71.G05.1.454.CMB.2.raw
  modified_base (228)..(228): a, c, t, g, unknown or other
  modified_base (315)..(315): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctcccacaaggtgtcctgtcacaagtacagctgcagcagtcaggtccaggactggtgaacgccctcgccacgacccctctcnctcacctgtcgccatccgtccgggacagagtcgactgcgacagtgtgtcgttgcacgtggtcagccacgtcccatcgagagtcgagnggtcggcgtagggaaagtactaagttactttacacgtacgtaccctaaacgaacggttaagggtaaaaactaaccgttaaaaaatttcgggtacgtacccgtaaacccttatttaccggttaggtttacggaaaaggttaaccggtaccgttaaacggttaacggaaactaaaaccgttacgaaaaccggttaaacggaaacctaaacgtaacgttaaaccgaaaacgggtaaacccttaaacccgggtttcccgtttacccccaggtaacctaaccggtactaacccgtaaccgtttcgtacgggtttaccaaccccgggtaaccccgggtaaggtacccgttaaacggggttaccttagggttaaacttccggttaggttaaacgggggaaccgttaaccgacccccgtagttaaaacccg

SEQ ID NO: 431502 - DNA, 775 bp, Homo sapiens
  misc_feature: GZ8MTXP02IPY14.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctccacaaggtcgtcctgtacaacaagtacagctgcagcagtcaggtccaggactggtagaacgccctcgacacgaccctctcgctcacctgtcgccacgtccgtccggggactacgacgtcgacgtagaccgaacgtggttcgttcggtcgttcgggtacctacggttcgggtaccgacggcctaaccggttaccccagttaccggacggtacggtaccgtagggtaggtacgggtaccggtaggggaaacggtactaagtttacgtttacgacgttacgtacccgaaacgtacggtaaacggtaaattaaacgtaaatttacgtacgaactaacctagttcgtaggttaagagttacgtaccgtaatacgaaactaagttaccgaaacggttaacaaacaacgttaacgaaccggtaaaacgtaccgttaacgttaccctactaacggttacaacccgtaacggttcctaaaaccgggttccccttaggttaccggtaaacccgtaaaccccgggttaccggaacgggttaaaccccggtttaggtttacgttaaaacgtttaacggttaaccggttacgggtaaaacggaccccggtaaaccccgggtttaacccaaaacggg

SEQ ID NO: 431503 - DNA, 614 bp, Homo sapiens
  misc_feature: GZ8MTXP02H7VZF.19.71.G05.1.454.CMB.2.raw
  modified_base (229)..(229): a, c, t, g, unknown or other
  modified_base (241)..(241): a, c, t, g, unknown or other
  modified_base (251)..(251): a, c, t, g, unknown or other
  modified_base (266)..(266): a, c, t, g, unknown or other
  modified_base (276)..(276): a, c, t, g, unknown or other
  modified_base (280)..(280): a, c, t, g, unknown or other
  modified_base (361)..(361): a, c, t, g, unknown or other
tcagtactctcgtgcacgaccggtgctcgatttagtgtcgtcgcaagagagaggggggaggtacaacaggcaggcaggggcagcaagatggtgttgcagacccaggtctttcatttctctgttgctctggatctctggtgcccacggggacatcgtgatgacccagtctccagactccctggctgtgtctcgtggcgagcgggccacatcaactgacaagtccagccanaatctttttaanacagtacaanaatataaactactanctagacaganaganacagacacgcctcgagctgctactatttacgaggacactaccgtaaccggacgtccggtacccagacgtatacgagtggcnggtcgggtactgggaactagtacttcactcctacaactagtacagacgacgaccgacgacgacggtacgtagtaaagtagtaggtacggtagttagtttagtttaattacgtaacgtaaactaaacttaattaattaacgttacgttacggttacggtacggttacggtaacggtaaacgggtaaacgtaaacggtaaggtaagtaacgtaacgaacgtaaacgtaaacgtaacggtacggtacgtacgtacg

SEQ ID NO: 431504 - DNA, 633 bp, Homo sapiens
  misc_feature: GZ8MTXP02FWL9W.19.71.G05.1.454.CMB.2.raw
  modified_base (239)..(239): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcnccagtccgtccggggacagacgtcgctagcgacgtagtgttcgcttggctacgtgggtcacggcctacgtccccagtacggagtacgggttctaaggaggtcgggacgtaggggaaaggtacctaattagtttacagttacgtccaaacgtacggttaggaaaacttaaactaaagtttatacgactactaatcgttaggtagagtacgtcgtaacttagactaaacgtacaaacgtaacgaactaacgataaccgaaacgtaaaccgtcgttaccttacccgtagacctacgcgtaccgtacttcgtacgtacgtacccgtaccggaacgggtaccgtacggtacgttattaacgttacgaggtacggaaccgacggtaccccgtagtaaccg

SEQ ID NO: 431505 - DNA, 682 bp, Homo sapiens
  misc_feature: GZ8MTXP02FUH9E.19.71.G05.1.454.CMB.2.raw
  modified_base (246)..(246): a, c, t, g, unknown or other
  modified_base (329)..(329): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccaccatcaactgacaagtccagccaactaattctttanactacgttaccaaacaatagaaaactacttagcttaggaccagacagagaccaggacacgcctcgaggctgctctatttacgnggctacgtccgtaccgggaacgtccggggtccccctacggacccgtattcgaggtcggcgacgggtcgggtcgtaggggactaggttactttaccgacttcctaccaaccgtctacgacgccgtacggcccttaggaccgtagggtacctagggtaaaacgtacggttgggttacggtacctttaaggtttttaactttagtttacgtaaactaaacttaaattttaagtttaacttacgtttacgttacggttacgggtaccggtttaccggaaccggtaaaacggggtaccgtaaagggttacgtaattacgtaacgaacggaacgtaacggtggtacggactacggaccc

SEQ ID NO: 431506 - DNA, 623 bp, Homo sapiens
  misc_feature: GZ8MTXP02JAYCU.19.71.G05.1.454.CMB.2.raw
  modified_base (256)..(256): a, c, t, g, unknown or other
  modified_base (328)..(328): a, c, t, g, unknown or other
  modified_base (545)..(545): a, c, t, g, unknown or other
  modified_base (576)..(576): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtacgaacgccctcgcacgacccctctcgctcactgtgccagtcgtccgggganagacgtcgctagcgacgtagtgttgaccgttggctacgtgggtcacggcacgtcccagtcgagtagtctagngtggcgtagggaacgactagttacttcagttcgtcccgaaagtacggtacggtaaataacgtaaatttacgtacgacctaaccgtatttcgtaggttaccgaggtaactcgtaacgtacgaactaaacgactaaacggtacaactaacaacgtacgaaacgtaacccttagttaccctaccgtaggacacggtactcgaacccttcgtaggtaaccncccggtaaacgaacgggtaccgtacggggtntaacttaacgtcggtacgtaacggacgtacccgacctaaggtaaccg

SEQ ID NO: 431507 - DNA, 652 bp, Homo sapiens
  misc_feature: GZ8MTXP02JOCPB.19.71.G05.1.454.CMB.2.raw
  modified_base (230)..(230): a, c, t, g, unknown or other
  modified_base (243)..(243): a, c, t, g, unknown or other
  modified_base (305)..(305): a, c, t, g, unknown or other
  modified_base (352)..(352): a, c, t, g, unknown or other
  modified_base (396)..(396): a, c, t, g, unknown or other
  modified_base (406)..(406): a, c, t, g, unknown or other
  modified_base (433)..(433): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctctttcttcctgcccgtgctgggcctcccacaaggtgtcctgtcaacaagtacagctgcagcagtcaggtccaggactggtgaacgcccctcgccacgacccctntcgctcacctgcnccacgtccgtccggggacagcgtcgctagcgacaggttgttgacgtttggccaggttcgggngacggtcacgtccccagtcggagtggtctagagtggcgtagggaagntagtatttcgattcgccaaagtcggaagtaaataacgaaatttnaccgacactntcgtaggttagagtactccgatacganaaactaccgtaaacacgaactaaccgtagtaaccgtaaacggaaccctaaggtttcccctacccgtaagtccgaaacggttctaccggttaaaccccttcgtacggtttaccgaaccccgtacggggtaaccggacccgggttaaaggggttcttaaagtaaccgtttaacgtaccggggttacggaaaccggtaccccggacccctaaagttaacccg

SEQ ID NO: 431508 - DNA, 670 bp, Homo sapiens
  misc_feature: GZ8MTXP02I3FK0.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtggtcaggcacgtccccatcgagaggtctaggaggtggcgtaggggaaggacaagttactttcgattcgtaccaaacgtacggtaggtaaactaacgaaatttacagacctacctaacgtcgttagttagaacgtacgtacgacgtagaactaacgtacgtaaacgtagaactaacgtaacgtaacggtaaacgtaaacccttacggtttaccctaccccgttaggtacccaaccggtaccgtaccgtaacccttcgtcggtttaacccggacccgtacccggtaagggaccgtacggggttataacgttaacgttacgtacggttacgggaaacgaccgggtacccctaagttaccgactactcgaacccgtaaccgttcgtacgttccgtggttacgtacgtttaagg

SEQ ID NO: 431509 - DNA, 654 bp, Homo sapiens
  misc_feature: GZ8MTXP02IVI3Y.19.71.G05.1.454.CMB.2.raw
  modified_base (215)..(215): a, c, t, g, unknown or other
  modified_base (232)..(232): a, c, t, g, unknown or other
  modified_base (242)..(242): a, c, t, g, unknown or other
  modified_base (253)..(253): a, c, t, g, unknown or other
  modified_base (258)..(258): a, c, t, g, unknown or other
  modified_base (264)..(264): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatacaacngacaaagtccagccaanaatctttaanacacgtacaanaatanaaactntagcttacgacagacagacgacagacacgctacgtaggctgactacgtatttacgcggacctagtaccgtaaccggagtcccggtacccacgaccgtagtacaggtgaccgtgggccggtagtaggactagtacttcactcacaccagtacacgacgacgacgtacgacgacgtacgtaacgtaaagtaagttacggtacggtacgttaagtttaagtttaacgttaacgttaactaaactaaattaaactttaaactttaaacgtttaacgttaccggttacggttaacggttaccggtaaccggtaaaccgggtaaacggtaaacggtaaacggtaacgtaacgttaacgtaacgtaaacgtaaacgtacgtacggtacgtacgtacg

SEQ ID NO: 431510 - DNA, 779 bp, Homo sapiens
  misc_feature: GZ8MTXP02FG63N.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcaccctgtcgccagtccgtccggggacaggagtcgcgtagcgactaggttggttgtcgtttgggcctacgtggggtcagggcctacgtcccccaagtcggaggacgggttctaggaggtgggacgtagggggaagtacaattatttcgattcggtacccaaaacgacggtaaggtaaaacttaactaaaatttactacgacctaacctagttcgttaggtttacggaagtaacggtaccggtaaactacggtaaccaaaacttaaccgtaaaaccggtaaacgaaaccgtaacctaaacgtaacccgggtaaaaaccgggtaaaccccgttaaccggttttacccccttaccccggttacggtacccgtaaacggacccgttacgtaaacccccgtttccgtacggttaccggtaaaccccggtacccccggggtaaacgggtaaacccgggttaaccgggggtaagtttaaacgttaaacgtttaacggttacggggttaacggggaaaccggtaacccgggaacccccccgtaaggttaaaacccg

SEQ ID NO: 431511 - DNA, 605 bp, Homo sapiens
  misc_feature: GZ8MTXP02JU50S.19.71.G05.1.454.CMB.2.raw
  modified_base (232)..(232): a, c, t, g, unknown or other
  modified_base (402)..(402): a, c, t, g, unknown or other
  modified_base (411)..(411): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcattttctctgttgctctggatctctggtgcccacgggacatcgtgatgaccctagtctccagactccctggctgtgtctctgggcagcggccacatcaactgcaagtccagccacaatctttanacagttcaacatagaaactacttagcttagtaccagctagagaccaggtacagcctcgtagctgctcattacagggcatcgtaccggggaatccggggtcctacgaccgattcgagtggcagcggggtctgggacagtatttcgactctaccactatacagcacgtccgngacgacganagaagtagtcggtagtacgtaagtttataagtttagaccgtaaagtaagtttaacttaagtttaaactcgtttaacgggtacggttaacggtttcggaaaccggaaaacggggtacctaaaggggttacgaaagtttactaaccgaagggtaaaacctaaccgtggttaaaccggccttagacccgtaaacccg

SEQ ID NO: 431512 - DNA, 669 bp, Homo sapiens
  misc_feature: GZ8MTXP02G5W5G.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgccagtccgtccggggacaggacgtccgctacggcgtaacgtaggtgttcgcgtttggcctacggtcggggtacacgggtccaccgtccccagtaccggaggtaggtcgtaaggtggtgggtacgtaggggaaagtacgtattacgttcagttcgtacctaaacgtacgtagaaattaactaaagttactacgacctactacgttcgtaggttagaacggtacgtaccggtaactaacggtaaactaaactaaccgtaaaacggtaccaaactaacgtaacgtaaaccgaaaacgggtaacccttaccgtttcccacccgtaggacctacgtacgtacgtacccgtagtacgtaccgaccgtacggacggtacgtaacgggtcttaagtaagttacggacggtaacggaccgaccgtacccaagtaaccg

SEQ ID NO: 431513 - DNA, 645 bp, Homo sapiens
  misc_feature: GZ8MTXP02JDZJN.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgtgcttggcagtggtcaggcacgtccccagtcgagaggtctaggagtcggcgtaggggaagtactattactttcattcgtccaaacgtacggtaggaaacttaacaaattactcgactactatcttaggttacgagtacgtaccggtacttagaactaacgtacgaaacgtacgaacactaacgttaccggaaacgaacccttacgttacccttaccccgtagacacggtacctacggtaccctacgttacggttaccgtaaacccgtaccccgggtaaacggtaccgtaccgggggttactttaagttaaccgtttacggttaacggttaacgggtaaaccggtacccgggaaccccctaaagtttaaacccgg

SEQ ID NO: 431514 - DNA, 602 bp, Homo sapiens
  misc_feature: GZ8MTXP02GN83V.19.71.G05.1.454.CMB.2.raw
  modified_base (440)..(440): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgccctcgcacgaccctctcgctcacctgtgccagtcgtccggggacaggagtcgctagcgactagtgttgctttggctacgtgggtcaggccacgtccccagtcgagtaggtctagagtggctaggggaagactattacttcagttcgccaaacgacggtaggaaattaacgtaaatttagcgacaacctatcgtgttagaagtagtcgatacgaaactaatacgaaacgtanaaccacaacgtacggaaaactaaccgtagttcccgtacccgtaggacacgtcgtacgtaaccttcgtacggtacgacccgttacccggaaggtaaccgtacggggttattaacttaacgtttaacggaggttacgggaacgacccggaccccttaagtaacg

SEQ ID NO: 431515 - DNA, 616 bp, Homo sapiens
  misc_feature: GZ8MTXP02JJ4RL.19.71.G05.1.454.CMB.2.raw
  modified_base (329)..(329): a, c, t, g, unknown or other
  modified_base (390)..(390): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccacgtccgtccggggacagagtcgctagcgacagtgttgcgtttggcacgtgggtcaggccacgtccccagtcgaggtaggtcgtaggngtgggcgtaggggaacgatatatttcatcgtccaacgacggtagtaaactaataaattacncgacctactattcgttaggtgagtacgtcgaactgaaactatacgtaaacgtagaacaacgtagtaaccggaaacgtaaccgttacgttccctaccgtcgaactcggtccttacggtacccttcgtacggtacgtacccgtacccgggaaggtaccccggtaaggttacttagtaacgtttaccgtaagggtaacggaacgttacccggaacccctaagtaaccgg

SEQ ID NO: 431516 - DNA, 590 bp, Homo sapiens
  misc_feature: GZ8MTXP02H15KO.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttccctcttcttcctgcccgtgctgggcctcccacaaggtgtcctgtcacaagtacagctgcagcagtcaggtccaggactggtgaagccctgcaacgacccctctcgctcacctgtcgccatccgtccggggacagagtcgctagcgacagtgttgcttggcacgtgggtcaacggcacgtccccagtccgagtaggtctaggagtggcgtaggggaagtactatagtttcaattcgtccaaacgtaacggtaggtaaactaataaaattatacgaccaacctatgttgttagaagtagttccgaatagaactaatacaaacgtaagaacgaacaatacgaaacgaaacctaacgttacctacccgttcgacacgactacgtaacctcgtcgtacgtaccgtacccggacggacgtaccggtaggtataattacgtacggtaggaacgaccggtacccgaacgtaacg

SEQ ID NO: 431517 - DNA, 697 bp, Homo sapiens
  misc_feature: GZ8MTXP02GDVH9.19.71.G05.1.454.CMB.2.raw
  modified_base (647)..(647): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcaacaagtacagctgcagcagtcaggtccaggactggtgaacgccctcgcacgaccctctcgcctccacctgtcgccacgtccgtccggggacaggacgtcgacgtacggacgaactaggttggttcgcgtttcggactacggtcgggtacacggccacgtccccagtcgagacggttctaaggaggtcggacgtaggggaaggactaagttaactttcgaacgttcgtacccgaaacgtacggttaaagggtaaaacttaaacgtaaaatttacgtacgtaaccaaaccttaagttccgttagggttacgaaagggtacgtaccgtaacgtacgaaactaaacgttaaccgaaaacgttacgaaaccaacgtaacgtaacggaaaaccggtaacctacgtttacccaccgttacgacgacgtcctacgtaccctcgttcggtacgtacccgtaccgggaacggtaccgtaacggggttntaacgttaacgttacgtaggtacggaacgtacccggtacccagtaaaccg

SEQ ID NO: 431518 - DNA, 629 bp, Homo sapiens
  misc_feature: GZ8MTXP02IDLM6.19.71.G05.1.454.CMB.2.raw
  modified_base (303)..(303): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactgggtgaagccctcgcacgaccctctcgctccacctgtcgccatccgtccggggacaggacgtcgctagcgacgagtgtgcgttggctacgtggtcaggcacgtccccagtcgagtaggtctaggngtggcgtaggggaacggactatttattacatcgtacccaaagacggtagtaactaactaaaattgtgacctactatcgttaggtacgtaggtagttcgtactagtaaaccgtaattaccgaaacggtaacacgaactaacgtacgaaacaccgtaacgttccctccgtatacgacgtcctacggtacctcgtacggtaccgacccgtaccggacgggtaacggtacgggttagttagttacgttacggtaggtacggaacggaccgtaccccgagttacgacgtactcgaaccctcgtaccgtctcgtcggtacgtactttaacgg

SEQ ID NO: 431519 - DNA, 766 bp, Homo sapiens
  misc_feature: GZ8MTXP02JKMEB.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtacgaacgccctcgcacgtaccctcgtccgcctcacctgtacgcctacgtccgtccggggaacaggacgtcgacgtacgccgacgtaggttggttcgtaccgtttcggccgtacggttcggggtccgacgggtaccctaaccggtacccccgagtccgggaaggtacgggtacgtaagggtacggtacgggtaccgggttaacggggaaacggtaccttaagttaacgtttacgaacgtttaccggttacccgtaaaaccggttaacgggttaaacggtaaaacttaaaaccgttaaaagttacgttaccgaaccctaaacccgttaaggttacccgttagggtttacgaaacggttaacggtacccgtaaacgttaggaaaacctacgttaaaccgaaaccggtaaacgacaaacgtacgtaaacggaaacgtaaccctcgttacctccgagacgtacgtacgtacgacctttcgtaggccgtacccggtacgacggtaccgtacgggttaatacgtcgttaacggtacggtaacggaccgtacccggtaccgtagtaaccg

SEQ ID NO: 431520 - DNA, 641 bp, Homo sapiens
  misc_feature: GZ8MTXP02HS94C.19.71.G05.1.454.CMB.2.raw
  modified_base (295)..(295): a, c, t, g, unknown or other
  modified_base (356)..(356): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcactgtcgccatccgtccggggacaggacgtcgctagcgactagtgtgcgttggcacgtggtcaggcacgtccccagtcgagagtctagngtggcgtaggaagacgtattagttcatcgtaccaacgtacgtaggtaactaactaaatttnacgactacctattcctaggttagacgtacgttacgaacgttacgaactaactacgtaaacggtacaacgaacgaacgttaacgaaacgtaaccgtaacgttcccttacccgtcggacctacgtcgttacgtaccttcgtacggtaccgtaccgtacccggacggtacggtacgggttattacgtttaagtacggttggtaacggaacggtaacccgaccccgtaagtaccgaccgtacttccgaacccgtacgttacgttcgtcgttcggtactacgtttacggg

SEQ ID NO: 431521 - DNA, 613 bp, Homo sapiens
  misc_feature: GZ8MTXP02HCIZG.19.71.G05.1.454.CMB.2.raw
  modified_base (483)..(483): a, c, t, g, unknown or other
  modified_base (518)..(518): a, c, t, g, unknown or other
  modified_base (574)..(574): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttctcctgcccgtgctcgggcctcccacaaggtgtcctgtacacaagtacagctgcagcagtcgaggtccaggactggtagaacgccctcgacacgaccctctcgctacctaccgttgtacgacccagtccggtcccggggaacaggtacgtccgacgtagcgacgtagttcgttgcgttggcgtaggtcgggtacgaggtccacgtccccgtaggcgtaacggtgtacgtagacggtgggacgtaggggaaccgactagttctacgactcgtaacacgtacgagtaataaaccgtaattgagactaacctagtcgtagtaagagtaacgtcgacctagaacgtaaatcgtaaacganaacacgataacgaacgtaacgtcctaccgtaccgngtacaacggtctacgaccctgtacggtccaaccggtcgaacgggtacgtacgttanattacgtaaggtagacggaacgtccgacctaggtacacg

SEQ ID NO: 431522 - DNA, 850 bp, Homo sapiens
  misc_feature: GZ8MTXP02I9U48.19.71.G05.1.454.CMB.2.raw
  modified_base (154)..(154): a, c, t, g, unknown or other
  modified_base (236)..(236): a, c, t, g, unknown or other
  modified_base (254)..(254): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccanaaggtgtcctgtcacaagtacagctgcagcagtcaggtccaggactggtgaacgccctgccagaccctctcgctcactgtcnccatccgccggggatagngtcgctagcgacagttgtcgcgtttggctacggttgggtacgacggccgtaccgtccccctaaggtacccggtaggtaccggttacgtaacggtaggtcgggtaccggttaggggaaacgtacctaagtttaacgtttacgtacgttaccgtacccgtaaacgttaccggttaaggtaaaaccttaaaccgtaaaagtttacgtaccgtaacctaaaccgttaactttccgggttacgggtttaaggaacccgggttacggttacccgggttaaactacggtaaacctaaaacggttaccgtaaaaccggggttaacaaaccctaaacggtaacggtaacccggtaaaacgggttaaaaccccttacggtttttcccccgtaacccgggtacgtaacccgtacggttacccgttaccggttaaccccgttaccgggttaccgggttaaacccgtaaaccccgggtaaaccggggtaacggttaacccggggtttaacgggtttaactttaaaccggtttaaccggttacggggtaaaacggggtaaaccccggggtaaacccggttaacccccggtaacccgtaaaaggttaaccg

SEQ ID NO: 431523 - DNA, 613 bp, Homo sapiens
  misc_feature: GZ8MTXP02IN7M5.19.71.G05.1.454.CMB.2.raw
  modified_base (304)..(304): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctcttctcttcttcctgccgtgctggcctccacaaggtgtcctgtcacaagtacagctgcagcagtcaggtccaggactggtgaagccctgcagaccctctcgctcacctgtcgccatcgtccggggacagagtcgactagcgacagtgttgcttggcacgtggggtcaggccacgtccccagtcgagnggtcaggagtggctaggggacgactattatttcagttacgtaccaagtacgtaggaaacttaaacgtaaattactagaccaacctattacgtagtttagaagtacgtacgagtacgaaactaaatacaaacgtaagaacaacaacgttacgaaacgaaccgtaacgttactccccgtaggactacgccgttacgacccttcgttacggtacgtacccggtacccggaacgggtaacggtaacgggttacttaaacgttagttaaccggtaggtaacgggaaacggtacccgtacccgtaaatacgaacg

SEQ ID NO: 431524 - DNA, 678 bp, Homo sapiens
  misc_feature: GZ8MTXP02FF0OJ.19.71.G05.1.454.CMB.2.raw
  modified_base (277)..(277): a, c, t, g, unknown or other
  modified_base (284)..(284): a, c, t, g, unknown or other
  modified_base (298)..(298): a, c, t, g, unknown or other
  modified_base (398)..(398): a, c, t, g, unknown or other
tcagtactctcgtgcacgaccggtgctcgatttagtgtcgtcgcaagagagagggggggcagagtctgctgaattctggctgaccagggcagtcaccagagctccagacaatgtctgtctccttcctcttcttcctgcccgtgctcgggccctcccacaaggtgtcctgcacaagtacagctgcagcagtcaggtccaggactggtagaacgccctcgcacgaccctctcgctcacctgtcgccagtccgtacggggacagtacgtcgctagcaacngtgtcgnttggcacgtggacnggcacgtccccaagtcgagaggtctagagtcggagaggggaagtactaattctttaccaatcgtacccaaacgcgggttataaaatacctaaaagtttcncaaccaacctaattccgtaggtttgaaaagttcgtacggtaaaccgtaaagaactaaacgtaaaccgtaaaccgtaaacgaaacgaacgtaaacgtaaccgtaaaaccgtaaaccgttaccgttacccgttaccgtacgtacgtacgaccgtacgtaccgttaccgtacgtaccggtaacccgtaacccggtaacggtaaccggtaacgggttaacgttaacgttaacgttaacggtaacggtaacggtaaaccggaacccggtaacccgtaacgtaacg

SEQ ID NO: 431525 - DNA, 762 bp, Homo sapiens
  misc_feature: GZ8MTXP02FJO5L.19.71.G05.1.454.CMB.2.raw
  modified_base (276)..(276): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgccgtgctgggcctccacaaggtgtcctgtcacaagtacagctgcagcagtcaggtccaggactggtgaacggccctcgacacgaccctctccgctcacctgtcgccacgtcgtaccggggacagacgtcgctacgcgaacngttcgttgcgtttggctacgtgggtacagggctacgtccccaagtccggagacgggttctaggaggtcgggtcgtaggggaaacggtactaatttacgtttacgacgttacgttacccgaaacgtacggttaaaggtaaactttaaaactaaaagtttactacggtaaccctaaacctacgtttaccgttaggtttagggaaacgttacggtacgtaaccgttaaacggaacctaaaacgttacccgtaaaaacggtaacggtaaccaaacgtaacgttaaaccgggaaaacggttaaacccttaacccgtttaccgttacccccgagggttaacccctaccgtaccgttaccgtacccgttacggtaccggtaccggtaaccccgtaaccggggacggttaacccgggttacgggtttaattaaacgtttaacggttaacggttaacgggaacgggtaaccggtaacccgtaccgtaaacgtacg

SEQ ID NO: 431526 - DNA, 726 bp, Homo sapiens
  misc_feature: GZ8MTXP02J1NLN.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctccgctcacctgtcgccacgtccggtccggggacaggacgtcgactacgcgactaggttgttcgcgttggctacgtgggtcaggcctacgtccccagtcggagtacggtctaggtcggtggacgtaggggaacgtactagttactttcaacgttcggtacccgaaacgtacgggtaaggtaaacttaaacctaaaagtttacgtacgaaaccctaacccgtagtttaccgttaggtttaacggaacgttacgggtaccgtaaacgttacgtaaaaccgtaaacgttaccgtaaaacgggttacgaaaccctaacgaacgttaaaccggaaaccggttaaccttacgtttccctaaccccggcgtaccgtacgtaccgtacgtaccttcggtacggtaccgtacccggtaccggtaacggtacggttacggttaacgttaacgttaacggttaaccggtacggggtaaccggaacccggtaccccgtaacccgtaagtaccg

SEQ ID NO: 431527 - DNA, 625 bp, Homo sapiens
  misc_feature: GZ8MTXP02FMHP5.19.71.G05.1.454.CMB.2.raw
  modified_base (241)..(241): a, c, t, g, unknown or other
  modified_base (315)..(315): a, c, t, g, unknown or other
  modified_base (323)..(323): a, c, t, g, unknown or other
  modified_base (392)..(392): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctctgggcgagcgggccaccatcaactgacaagtccagccacaattctttanacagttaccaaacaatacgaaaactacttagcttaggtaccagacagacgaccaggacagcctctaggctgctnatttacgnggcatccgaccggatcccggggtccccctaggacccgtattcgaggtcgcgtaggccgggtctgggacngtactttccacttcctcacctatcacgcacgccctagaccgagggctaggaaagtagtaggtcggtagttagttttattagttacgtaactaaacgttaaattactttaattaagttacgttaggttacggtaccggttaccgggtaaacccgtaagggaaacccgttaaagggtaggtaacttaacgtaacgtaacgtaacggtaaacgtcgggtacgtacgtacgtaaccc

SEQ ID NO: 431528 - DNA, 716 bp, Homo sapiens
  misc_feature: GZ8MTXP02HOFBF.19.71.G05.1.454.CMB.2.raw
  modified_base (155)..(155): a, c, t, g, unknown or other
  modified_base (231)..(231): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccanaaggtgtcctgtcacaagtacagctgcagcagtcaggtccaggactggtgaacgccctgcacgccctctcgctacncctgtcgccagtccgtccggggacagacgtcgctacgcgacagtgtgcttggctacgtgggtcacggctcgtccccagtcgagaggtcgtagaggtggacgtaggggaaacgtacgtagttacgttttacagttcgtacctaaacgtacggttaacggtaaacttaaacgtaaaatttacgtacgaaccgttaaccaacgtttcggttacgtttaggaacggttaacggttacggtaaaccttagggtaacctaaaacgtaacgtaaaaccggttaaacggtaaccgaacttaaacgtaacgaaaaccgggtaaaacccttacgttaaccccgttccgttaacggaccggtactaccggtcgtaaacccgttcgttaacggttccggaaacccggttacccggaaacgttaaccgggacgggttattaaccgtaagttaacgtacggttacgggaaaacgcccggtaccccgaaaagttacccgg

SEQ ID NO: 431529 - DNA, 716 bp, Homo sapiens
  misc_feature: GZ8MTXP02FUXOK.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtagaacgccctcgcagaccctctcgctcacctgtcgcacgtcgtccggggacagacgtcgctacgcgacgtagtgttgcttggcacgttcgggtacaggtccgaacgtccccgagtaccggagggtacggttactaagggacgtacggggtacgtaggggaaacggtactaatttacgtttcaagttcggtaccgaaacgtacggtaggaaaactaactaaatttagtacgactaactacgttagttagttagacggtacgtacgtacgtaacgtaaacaacgttaacaaacgttaaacgaacctaacgtaaacgtaaccggaaaaccgtaaaccttaccggttaacccgtttcccacgtaccgtaacgtaccgtcggtaaccccttcgtaaccggttcgacccgttaacccggggaaagggtacccgttaaccgggggtactttaaaagttaacgtttaaacccggtaggttaaacgggtaaacccggtacggtaacccccgagtaaaccgg

SEQ ID NO: 431530 - DNA, 743 bp, Homo sapiens
  misc_feature: GZ8MTXP02I3PJ7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtcgaacgccctcgcacgaccctctccgcctcaccgtgtcgccacgtccgaccggggacagacgtcgcacgcgacgtaggtgttcgtcgttcggcgacggtgggtcacggccacgtccccagtacggaggtacggttactaggacggtggacgtaggggaagtactattactttcaacgttcgtaccaaacgtacggtaaagtaaacttaacgtaaaatttacgtacgtaaccctaaaccgttagttcgttaaggttacgaacggttacgtaccggtaacttaacggaaactaaacgtaaccgtaaaaccgttaacggaaacctaacgtaaacgtaacccgggaaaacgttaaaccccgtaccgtttaccccgtacccgtacggtaacctacggttaccgtacgtacccgtttacgtacgggttacccgtaacccggtacccggtaacggggttaacccggttaacgggttacgttaaacgtttaacggttacgtacggggtaacggtaaaccggaccccggtacccggtaataaaccgg

SEQ ID NO: 431531 - DNA, 627 bp, Homo sapiens
  misc_feature: GZ8MTXP02FIJ32.19.71.G05.1.454.CMB.2.raw
  modified_base (239)..(239): a, c, t, g, unknown or other
  modified_base (326)..(326): a, c, t, g, unknown or other
  modified_base (388)..(388): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccacaatcttttanactagttaccaacaatagaaaacttacttagtccttaggtaccagcagacgaccaggacagccctcctaggctgctactatttacgngggcagtccgtacccgggatcccggggtcctcgaccgtatcgagtcggacaggccgggtcgngggactagtactttcactctacaccactacagcacgcctgacgacggctagaacgtatcgggtaggtctagttttattagtttacgtaacctaaataatttaactttaatttaacgttacgtttacgggttacggtaccggtttaccgggaccgtaaaacggggtaaccgtaaacgggtagtaacgtaaacgtaaacggtaaccgtaacgtcggtacggcctacggacctaacctacgg

SEQ ID NO: 431532 - DNA, 768 bp, Homo sapiens
  misc_feature: GZ8MTXP02ILGVU.19.71.G05.1.454.CMB.2.raw
  modified_base (245)..(245): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgaggcgggccacatcaactgacaagtccagccactaattcttttaanactaacgttccaaactaatagtaaaactacttagtaccttaggtacccagacaggaacgacccgaaggaccacgccctaccgtaggcctagtcctactacttttaccgcggggacctaacgtacccggtaaccccgggggaaccgttccccgggggtacccccctacgggtacccgtacgtttaccgtacggttcgggaccgtagggggtcccgggggttacgttacggggggaaccctagggttactttaccctaccgttaccctaccaacccgtactaccgaacggccgaccgtcccgtacggacccgtaagggtccgttaaggaaacggtagtagggttcggttaccttaaggtttttaacttacgttacgttaactaaaacttaatttaattttaactttaagttaccgttacgttacggttaccggtttaccgggaacggtaaacggggaccgtaaaggggtacgtacgtaagtaaccgaaacggtaacggttacgttggtacggtactacgtaaccc

SEQ ID NO: 431533 - DNA, 667 bp, Homo sapiens
  misc_feature: GZ8MTXP02F3NSO.19.71.G05.1.454.CMB.2.raw
  modified_base (244)..(244): a, c, t, g, unknown or other
  modified_base (274)..(274): a, c, t, g, unknown or other
  modified_base (326)..(326): a, c, t, g, unknown or other
  modified_base (389)..(389): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatgacccagtctccagacctccctggctgtgtctcgtgggacgaggcgggaccacgatcaactgacaagtcagccacaattctttanacgcgttaccaataatacgaaaactcttancttggaccagctagacgacagacagcctctaggctcgactctaatttacggngtactacgtaccgtaacgggtacgtccggtacccctagtaccgtgttacgacggtacgtacgngggtccggtacgtacgggtactacgttaacttaccgacttacccgactaaccgtactacgtacgtcgtacgtaccgtacgtacgtacgtacgtaacgtaacgtacgtacggtacgtacgttagtttacgttaacgttacgtaacgtaaacttaacgttaactttagttaacgttacgttacggttacggtacggttacggtaaccggtaaacggtaacggtaacggtacgtacgtaacgtaacgtaacgtaacgtacgtacgtacgtacgtacgtacg

SEQ ID NO: 431534 - DNA, 677 bp, Homo sapiens
  misc_feature: GZ8MTXP02HDT9J.19.71.G05.1.454.CMB.2.raw
  modified_base (239)..(239): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgccctcgcacgaccctctcgcctcacctgtcncctactccggtccggggacacggagtcgctagcgactagtgtgcgttggcacggtgggtcaggccacgtccccagtccggagtacggtcgtaagagtcgggcgtaggggaagtacctagttacgtttcagttcgtaccaaacgtacggtaggtaaacttaactaaagttatacgactaacctagtactaggttagaagtagtacgaactcgaaactaaacgtacgaaaccttaggaaactactaagtaaccaaacgtaaccgtaaccgttccctacccgtaggacccgtagtaccgtacgttacccttacgtcggttaaccgacccgttacccgggaaacggtaaccccggtaaggggttacttaaaaccgttaagttacgggttaacggttaaacggggaaaccgtaacccggggtacccccaaaggttaaacccgg

SEQ ID NO: 431535 - DNA, 604 bp, Homo sapiens
  misc_feature: GZ8MTXP02FXODQ.19.71.G05.1.454.CMB.2.raw
  modified_base (233)..(233): a, c, t, g, unknown or other
  modified_base (244)..(244): a, c, t, g, unknown or other
  modified_base (256)..(256): a, c, t, g, unknown or other
  modified_base (273)..(273): a, c, t, g, unknown or other
  modified_base (326)..(326): a, c, t, g, unknown or other
  modified_base (392)..(392): a, c, t, g, unknown or other
  modified_base (425)..(425): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatcaactgacaagtccacgccanaattctttaanacagttccaaanaatagaaaactactagnttggacagcagacaccaggtacagtcctcctaggctgcttactagtttaccgnggggacctacgtccgtaacccggtaacgtcccggggtccccctagtccgagtttcgagtcggaacncggggtgggccttagggggactgtactttaccncgtctacactagacgacgacacgcctcgacgacgagagagtagtgtagtacgttagttattattatactaataattattattattacgttacgtacggtacgtacggtaacgtaacggtaacgtacggtacgtagtacgtaacgtaacgtaacgtacgtacggtacgtacgtacgtacg

SEQ ID NO: 431536 - DNA, 607 bp, Homo sapiens
  misc_feature: GZ8MTXP02HAP35.19.71.G05.1.454.CMB.2.raw
  modified_base (297)..(297): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagtagtcgctagcgacagtcgttgcgttggcacgtgggtctaggcnggtccccagtcgaggtacggctaagaggtcggcgtaggggaagacgtattacgtttcaagttcgtaccaaactacggtaggaaaacttacaaaattatagtaccaaccgtaattcgttaggtagtaacggtaaggtcgtacttaagaacgaactactaaacgtagaactacagtaacgaaagaaccctagtacctcctaggcaggtactcgactacgtcggtataaccggtcccaaagggccgttaacggggacttaaccgtaaggttcctaggggtacggtaaaaggccccgggtaccccaacgtaacg

SEQ ID NO: 431537 - DNA, 642 bp, Homo sapiens
  misc_feature: GZ8MTXP02FJI4G.19.71.G05.1.454.CMB.2.raw
  modified_base (239)..(239): a, c, t, g, unknown or other
  modified_base (324)..(324): a, c, t, g, unknown or other
  modified_base (509)..(509): a, c, t, g, unknown or other
  modified_base (635)..(635): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcggccacatcaatgcaagtccagccactaatcttttaanactagttacccaacaatagaaaactactagcttaggtacagcagagaacagacagccctcgtacggctcgtcacgtactttaacnggggacctacgtaccgtaaccccggggtaaacgtccccccccggggtcccctacggaacccgtacgttacgtacggttacgggccggtaacgggccgggggttcgtacgggggactaggttaacttccgtaacctcttacccacctactcacgcgacgtccgagccaggcctagagtagtggtgnttagtttaattgttatactaaataaattagtttaatttattaacgttacggttacgtacggttaccggaccggttaaacgggaccgtaaagtggtaagtaacttagaaccggacgtaacgtcggtntacgtcg

SEQ ID NO: 431538 - DNA, 723 bp, Homo sapiens
  misc_feature: GZ8MTXP02JVQFP.19.71.G05.1.454.CMB.2.raw
  modified_base (252)..(252): a, c, t, g, unknown or other
  modified_base (489)..(489): a, c, t, g, unknown or other
  modified_base (599)..(599): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctccacaggtgtcctgtcacaagtacagctgcagcagtcacggtccgaggacgtggtacgaacgccccgtcgccaccgaccccttctccgcctccacctgtcncctactccggtccggggacaggcgtcgcgtacggcgacaggttgttcgtcgttgggcctacggtcgggtccgacgggacctaccggtacccccgagtaccgggaaggtacgggttaccggtaagggaagggttcggggacggttaacgggggaaacgggaacttaagttttactttaccgtagttaccggtaccctaaaccggtaaacgggtacgtaaaactaaactaaagtttacncgtaaccctaacctattcgtaggttcgaaagttacgtccggtaatacgaactacgtaaacgaaacggtacaaccgatacgtaaaccgaacgacccttagtccctaaccgngtacgtaccgtacctacgtaccctacggtacgtacccgaccgtaaccgggaacggtacgtaacggttattaaccgtaacgttaacggtcggtaaacggtaccggaaccccgtacctacgtaacg

SEQ ID NO: 431539 - DNA, 728 bp, Homo sapiens
  misc_feature: GZ8MTXP02FFQEN.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcacacaaggtgtcctgtacacaagtacagctgcagcagtcaggtccagggactggtcgaacgccctcgcacgtacccctctccgactcctaccgtggtcgcctagtccgtccggggacacgacgtcgcgtacgccgatacggtgttgcgttggctacgtgggtcgaggccgtaccgttacccccgagtaccggaaggtacggttaccgtaggtagggtacgggtacccggtaggggaaacggaactaatttacgtttaccgaagtttccgtaacccaaaacggtaacggttaacgggtaaacttaaaccgtaaaatttacgtaccgaaccctaacctagttacgtttgggttaagaacggtaccggtacgtaaacccgtaggaaaccttaacgtaaccgtaaaacggttacacccaaacgtaacgttaacccgaaaacgtaacccctttaacgttcccgttaccccgtagaccgacgtccgtacgtacccttggtaccgttaccgggacctaccgggaacggtacgacggttaataacgttacgtacgtcggtaccggaacgacccggtaccctaaag

SEQ ID NO: 431540 - DNA, 717 bp, Homo sapiens
  misc_feature: GZ8MTXP02IE48Q.19.71.G05.1.454.CMB.2.raw
  modified_base (182)..(182): a, c, t, g, unknown or other
  modified_base (202)..(202): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtnaagccctgcagaccctctcnctcacctgtgcctagtcgtcggggacagagtcgctagcgacagtgtgcttggcacgtggtcaggcacgtcccagtcgagagtcagagtggctagggaacggacagttatttcatcgtaccaaacgtacggtagaaaccttaaactaaaactttagtacgaccaaaccctaattccgtagttaggaaggtacgttaccgaacgttagaaaccgtaaagttacaaacccggttaaagaaaccttaacgaacgtaaccggaaaacgtaaacccgttacggtttacccctacccgtacgaccgaccgttttttaccgcggtaacccttcggtaccggttaacgaacccccggttaccggaaacggggtaccggtaaaccgggggtttagttaaacttaagtttaacccggtgggttaaaaccgggaaacggaacccgggtaacccccaagttacgaaacctaggtacccgaacctaccccgttcggttacctacggttcgggttactacgtttaacggg

SEQ ID NO: 431541 - DNA, 699 bp, Homo sapiens
  misc_feature: GZ8MTXP02JXO1W.19.71.G05.1.454.CMB.2.raw
  modified_base (401)..(401): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacacggagtcgctagcgacagtgttgtcgttggcagtgggtcaggccagtaccccagtcgaggacggtacaggaggtggtcgtaggggaaagtactagttacttcgagttcgtacccgaacgtaacgttagggaaataacgtaaattntacgactacctagttcttagtagagtacgtcgaactagacaatacgaaacggtacgtaacacgtaaagtaaccgaaacggtaaaacctaccgtttacccgtacccctaggacccgtaacgacccgttacggtacccgtttaccgtacggggtacccgaaccccggtttaaccccggggaaacggggtaaccccggttaacgggggtttcccggttaaaatttaaccggtttaaaccggttaggggttaccgggaaaaccgggtttacccccggaacccccggtaaattaaaccccggg

SEQ ID NO: 431542 - DNA, 744 bp, Homo sapiens
  misc_feature: GZ8MTXP02JPUCB.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacgaaggtcgtcctgtcacaagtacagctgcagcagtcgacggtccagggactggtacgaacgccctacgcacgtaccctcgtcgctccacctgtcgcctacgtccgtccggggacaggacgtcgcgtaggcgactagttgtgtcgttggcacggtggtcaggcacgtccccagtaccggagtacgggtctaggtacggtcgggtacggtacggggaacggtactaacgtttagtttacgaacgttcggtaccccgtaaacgttaaacggttaacggtaaaacttaaaccgtaaaacgttttacacggtaacccctaaacttacgtttaccggtttacggtttaaggtaaacggtacggttaccggtaaactttacggaaactaaaactaccgttaaaaccggttacggaaactaaaccgtaacgtaaaccgtaaacggaaaccctttaccgttaccccgttactacgtacgacgttacgaccgttaacgttcgttacggtaccgacccggtaaccggtacgggtaccgtacgggttagttacgtaacgttcgtaaacgggtcggaacgtacccgaccccgttaaggtaacc

SEQ ID NO: 431543 - DNA, 619 bp, Homo sapiens
  misc_feature: GZ8MTXP02HWTNV.19.71.G05.1.454.CMB.2.raw
  modified_base (504)..(504): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcacgaccctctcgctcacctgtcgccatcgtccggggacagagtcgctagcgacagtgttgcttggcacgttgggtcaggcagtccccagtcgagtagtctagagtggctcggggaagacaatactttcattggtcccaaacgtacgtaggaaataaccgtaaaatttaagtcgacctaaccgaaattcgtagtttgaaggtacgttcgaacctgtaaacctaaagttacccgaaaagttacggaaaccaacttaacgacgaaaacggaaccttaggttaccctacccgtnacggactcgtacgaacccttactcggttacaccgttaccccggaggtaccgtaccgggttaagtaacgttaacgttacgttaggaccggtaaaggtacccggtacccaaggtacg

SEQ ID NO: 431544 - DNA, 693 bp, Homo sapiens
  misc_feature: GZ8MTXP02IHCJC.19.71.G05.1.454.CMB.2.raw
  modified_base (439)..(439): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtgaacgccctcgcacgaccctctcgctcacctgtcgcctatccgtccggggacagagtcgctagcgactagtgttcgcgttcggactacggtcggggtcgaggtaccctaccggtcccccagttccggaaggtacggttacgtaaggtcggtcgggacggttacggggaaacggtactagtttactttcgagttcgtaccgaacgacggtaaggtaaaattaaacctaaattacngtacccaacttagttcttagggttacggaagtacggtaccaacgtacgtaaaccaagtacgtaaacgtaacgaccttaaagacgttaaaccgaacgtaaacccctagtttcccacccggtagccgacgtcctaacgtccccgtagtaacggtccgaaccgttacccgggaacgacgggttaaacggggtttctttaaacgtaacgttaacgggtacggtaccgggaaaaccgtccccggtaaacctaacgtacg

SEQ ID NO: 431545 - DNA, 741 bp, Homo sapiens
  misc_feature: GZ8MTXP02H7IEG.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtacacaagtacagctgcagcagtcaggtccaggactggtgaacgccctcgcaacgaccctctcgctcacctgtcgccatcgtccggggacagacgtcgctagcgacagtgtagcttggcacgttgggcaggcacgtccccaagtccgagtaggtctagacggtggacgtggggaaaacggactaattacgtttttacacgtttacgtacccgaaaacgtacggttaaacggggaaaaactttaaaccgaaaaatttttacgtacggaaaccctaaacccgattttacccggttaaggtttaccggaaaggttacgttaccggaacctttaaggaaacccctaaataaccgtaaaacggttacggaaaacccaacgttaaacgtaaccggaaaacggaaaaaccccttcgggtttaaccctccccgttaggaacaacggtctaccggtaaccccttagttacgtaccggaaacccgttaacccgggaaggtacccgtaaacgggggtttataaaccgttaagtttaacccgttagggtaaacggtaaccgaacccggggtaccccaagtaaaccgg

SEQ ID NO: 431546 - DNA, 780 bp, Homo sapiens
  misc_feature: GZ8MTXP02I8QDK.19.71.G05.1.454.CMB.2.raw
  modified_base (253)..(253): a, c, t, g, unknown or other
  modified_base (352)..(352): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcccgtggtctgtgtctcgtgggcgaggccgggcccacgatacaactgacaagtccagaccaataattctttanactacgttaccaaactaatacgaaaacttcttagccttaggaccagcaaggacgaccacggacacgccctacgtaggctagccttactactttaccggngggactaccgtacccgtaaccggggtaacgttccccggggacccctacggtaacccgtatccgaaggtcgacgtaccggggtcggggttaccgtagggggacccttaggtaacttttcccacgtttaccccgacgaaaccccgttaagtaccgaacggtacccgtaaccggtcccgtaacggacgttaacgggtaaccgtaaggggtaaacgttaggttacgggttacggtttaacgtttaagtttttaacttaacgtttacgttaaaacttaaagtttaaacgtttaacgtttaatttacggttacgttacggggtttaacggtaccgggttaaccgggaaccggtaaaacgggtaacggttaagggtacgtaagttaccgaaaccgaaacgggttaaccgtaggtacggtacgttaccgactaccg

SEQ ID NO: 431547 - DNA, 620 bp, Homo sapiens
  misc_feature: GZ8MTXP02ICFY4.19.71.G05.1.454.CMB.2.raw
  modified_base (314)..(314): a, c, t, g, unknown or other
  modified_base (322)..(322): a, c, t, g, unknown or other
  modified_base (329)..(329): a, c, t, g, unknown or other
  modified_base (331)..(331): a, c, t, g, unknown or other
  modified_base (339)..(339): a, c, t, g, unknown or other
  modified_base (345)..(345): a, c, t, g, unknown or other
  modified_base (374)..(374): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttctcttcttcctgccgtgctcgggcctccacaaggtgtcctgtcacaagtacagctgcagcagtcaggtccagggactggtagaacgccctcgcaacggaccccttctccgcctcaaccgtcgtcgccagttccgccggggacaggacgtcgctagcgaacagtgttgcgttgcagtgggcaggcacgtccancgagcgtnagagtgngnggaacganatattnatcgacacgtagtagaaatacgtaaattnctacacatgtgtagagtcgtacgatacgaacaactacgaaactagacactaagtaacgaaagtacctacgttacctcccgtaagaccgtagtaccgtaccgtaacgtcgtttacggacgttaacccggacccggtaaaggtaaacccggggtacgggttaaatttaaccggtttaagttaaccggtacgggggttaaacgggtacccggaaaccccggttacccccgaaagtttaaaccgtaccgg

SEQ ID NO: 431548 - DNA, 778 bp, Homo sapiens
  misc_feature: GZ8MTXP02FGYU7.19.71.G05.1.454.CMB.2.raw
  modified_base (285)..(285): a, c, t, g, unknown or other
  modified_base (293)..(293): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgttgcttggcacgtgggtcaggcacgtccccatcgagnggtctagngtggctagggaagactatatttcagttcgtaccaaagtaccggttaggaaaaccttaacaaaatttacgtacgacctaaccccttagttccgtagggttaggaaacggtacgttaccgtaaacttacggaaacctaaaacgtaaccgtaaaacccgttaacggaaacctaacgaacgttaaacccggaaaacgtaaaaccccgtaaacgggttttccacccccgttaggtacccgaaacgtacccgtccggtaccccgttattaccgggttaccgaaccccgttcccccgggggaaaggtaaccccggttaaacgggggttgttaaactttaaaccgtttaaacggtcgggttaaaacggggaaaccgggttaaaccccggggtaccccccaaaggttaaaaccgaacccggtacttaacccggcccctaaaaccggtttacccggtcctttaacgggttcggggtacttaaccgtttaacgggg

SEQ ID NO: 431549 - DNA, 626 bp, Homo sapiens
  misc_feature: GZ8MTXP02FQ8ZQ.19.71.G05.1.454.CMB.2.raw
  modified_base (241)..(241): a, c, t, g, unknown or other
  modified_base (251)..(251): a, c, t, g, unknown or other
  modified_base (256)..(256): a, c, t, g, unknown or other
  modified_base (288)..(288): a, c, t, g, unknown or other
  modified_base (300)..(300): a, c, t, g, unknown or other
  modified_base (348)..(348): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccaataatctttaanactatacaanaatanaaactatagtctagacagacagacgacagacncgcctcgagctnactctattcgcgctacgtaccgaccggtagtcccggtccacgaccgtntcgagtcggcgtacggtcgggtcgtacggactagttaccttacgacttaccaccaacctacgtacgaacgcgacgtccgtcgtacgacgtacgtaagagttacgttggtaacgttacgtttaagttttaatttaacgtacgtaacttaaaacttaatttaaacgtttaattaacgttacgtttcgtacggtacggttaccggaacggtaaacggtaacgtaacggtacgtactacgacgtaacgtaacgtaacgtacgtacgtacgtacgtacgtacg

SEQ ID NO: 431550 - DNA, 699 bp, Homo sapiens
  misc_feature: GZ8MTXP02H0D03.19.71.G05.1.454.CMB.2.raw
  modified_base (241)..(241): a, c, t, g, unknown or other
  modified_base (253)..(253): a, c, t, g, unknown or other
  modified_base (280)..(280): a, c, t, g, unknown or other
  modified_base (323)..(323): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctcagacctcctggctgtgtctcgtgggcgagccggccacatacaactgacaagtccagccacaattcttttaanacagttccaaanataagaaaactctagtctaggaccagnagataccaggacacgcctcgtaggctacgcttactatttacgngggtactacgttccggaaaccccgggagttccccggggtcccctacggtaacccgtattccgaaggttcggacacgggggtccggggttacttacgggggacctaagttactttaccaacctcccgtaaccacttacggacacgacgtacgtcccaggaaacccgaggtacgtaaaggtagtaggttacggtacgtttaacgtttaagtttacgttaacgttaacgtaaactaaaatttaactttaacgttttaacttaccgttaaccgggtttacggtaaccgggttaaccggtacccggaaacgtaaacggggtaacgtaaacgtagtaacttacgaacgtaacggtaacgtcggtaggtaccgtcgtacgacg

SEQ ID NO: 431551 - DNA, 648 bp, Homo sapiens
  misc_feature: GZ8MTXP02IXQ8W.19.71.G05.1.454.CMB.2.raw
  modified_base (180)..(180): a, c, t, g, unknown or other
  modified_base (240)..(240): a, c, t, g, unknown or other
  modified_base (249)..(249): a, c, t, g, unknown or other
  modified_base (348)..(348): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctggcctccacaaggtgtcctgtcacaagtacagctgcagcagtcaggtccaggactggtnaacgccctgcagaccctctcgactcacctgtcgccctatcgtaccggggacagacgtcgntacgcgtanagtgttgcttggacctgtggggtacaggccacgttacccccagtccggaggacggtctaggagtggtcgtagggaacggtacctagtttaagtttccgngtaccgtaaccgaacgtacggtagtaacctaactaagttcgtacactaccgtagttcgtagtacgacgtacgtacgtacgtagtaactaacgtacgaaacgtaacaacgaactaacgtaacgaaactacgtacgttccacctagacgtaccgtcgtaccgtacgtacgttacgaccgtaccgtacggtacggtacggttagttacgttaaacgtcgtttacggacggtacggaaccgtaccgtaacctaagacgtacgacgtccgaaccgtcgttcgtcgtacgttacgtcgtacgtacg

SEQ ID NO: 431552 - DNA, 638 bp, Homo sapiens
  misc_feature: GZ8MTXP02IJVBI.19.71.G05.1.454.CMB.2.raw
  modified_base (225)..(225): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctntcgctcacctgtgcccatcgtccggggacagacgtcgctagcgacagtcgttgctttggcacgtgggtcaggccagtccccagtcgagtacggtcgtagaggtggcgtggggaaagcctaattactttcagttacgtcctaaagtacgtaggtaaaactaccgtaaaatttcagacctaccgtattaccgtaggttacgaaggtacgtacgtacgttacgaaacctaaatccgtaaaacggttaactacctaaacgtacgtaaccgtaaaacggaaacccttcgtttaccctcccgttaggacctaacgtccgtacggtaacccttcgttagtaccgtaaccgttacccgggacgtaccgtaggggttctaagtaacgttacgtagtacggaacgtccgtaccctagtaaccg

SEQ ID NO: 431553 - DNA, 580 bp, Homo sapiens
  misc_feature: GZ8MTXP02GPGQ3.19.71.G05.1.454.CMB.2.raw
  modified_base (332)..(332): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactggtcaggcagtccccatcgagagtctagagtggctaggagacatatttcatgtccaacacgtgaactacaaatngcacatctgtgagagtcgatgacaatcaagtagacacaatacgaaacgaacctagttcctacccctagccacgtctcgtaacctcgtacgtcgaacccgttcccggaaggtaaccgtacgggttacgttaacgttaacgtttacgtagggttacgggaaacggtaccggaccccccgtaagtaaccgggaactacgttaccggaaccctaacccgttccgtacctccgtggttccgtacgtttaacgg

SEQ ID NO: 431554 - DNA, 614 bp, Homo sapiens
  misc_feature: GZ8MTXP02G1H3B.19.71.G05.1.454.CMB.2.raw
  modified_base (201)..(201): a, c, t, g, unknown or other
  modified_base (217)..(217): a, c, t, g, unknown or other
  modified_base (300)..(300): a, c, t, g, unknown or other
tcagtactctcgtgcacgaccggtgctcgatttagtgtcgtcgcaagagagaggggagagtctgctgaattctggctggaccagggcagtcaccagagctccagacaatgtctgtctccttcctcttcttcctgcccgtgctgggcctccacaaggtgtcctgtcacaagtacagctgcagcagtcaggtccaggctggtnaagcctgcagaccctntcgctcactgtgcatctccgggacagagtcgctagcacagtgttagcttgcactgggtcaggcagccccatcgagagtctagngtggctaggacgacagtattcgatacgtacacgtacgtaggaaactaacaaagtttacaggtacccaacctattaccgtagttacggtaagtacgttacgacttacgaaccgtaaataccgtaaaccgttaaagaacctaactaacgttaaccgaaaaggtaaaccctacgttaaacctcccgttacggacaacggtcctacgtaaccttaccgtcgttacgaaccttaccccggtaggaaacccgtaggggtaccgtaattacttaaccgtaggttaacggaaacgtaccggacccccgagtaacggtaaccg

SEQ ID NO: 431555 - DNA, 639 bp, Homo sapiens
  misc_feature: GZ8MTXP02IAKJO.19.71.G05.1.454.CMB.2.raw
  modified_base (250)..(250): a, c, t, g, unknown or other
  modified_base (410)..(410): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccagactggtgaacgccctgcagtaccctctcgctcacctgtgccatcgtcggggacngagtcgcgtagcacgagtgttcgcgtttggctacgtgggtcacggcacgtccccagtccggaggtacggtcgtagaggtggaccgtaggggaaaagtaccgtaattaacttttccgaagttcgtaccccaaagtacggtaggtaaactaactaaatttanacgaccactattctagtagagtacgtacgactagaactacgtacgaaacgtagaactaactagtaaccgaaacgtaacccgtacgttaccctaccgtagaccgagtccgtaaccgttaccgttaccgttacgggtaccgtacccggttaacccggaaggtaaccgtacgggttattaacgttaacgttacggtacggtaacggtaacgtaccggtacccgtaaagtacg

SEQ ID NO: 431556 - DNA, 666 bp, Homo sapiens
  misc_feature: GZ8MTXP02GPZN1.19.71.G05.1.454.CMB.2.raw
  modified_base (359)..(359): a, c, t, g, unknown or other
  modified_base (411)..(411): a, c, t, g, unknown or other
  modified_base (464)..(464): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtcgtctcgtgggcgaggccggccaccatacaacgtgacaacgtccacgacccaactaactttctttaatacctacgttaaccaaactaaatacgtaaaacttacttagtcttacggaaccagaccaagacgaccaaggacacgccctacgacggctcgctactatttacgnggacacgtacccgtaccggggtaacgtcccgggtaccccctacgaacccgtnttacggaggtcggaccgtgggtccgggtcggtagggaacctagttactttacnccttctacaccctatccgagccgactcctagaccgagggatagaaagtctaggtggtacttagtttacgtatacgtaactaaattaattatttacttaagttacgttacggtacggttaccggttaccggacggtaaacgggacgtaaaggtgtaaacttacggaacgaacgttaacgtacgtggtaccgtcgtacaacccg

SEQ ID NO: 431557 - DNA, 659 bp, Homo sapiens
  misc_feature: GZ8MTXP02FP8TZ.19.71.G05.1.454.CMB.2.raw
  modified_base (205)..(205): a, c, t, g, unknown or other
  modified_base (222)..(222): a, c, t, g, unknown or other
  modified_base (471)..(471): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctgcagaccctntcgctcacctgtcgccatcgtccggggacaggtacgtccgcgtagccgtacagtgttgcttggcacgtgggtcaggccagtccccatcgagtggtctagagtggcgtagggaacgactatacgtttccaagttcgtaccgaaacgaacggttacgaaaataacgtaaattaacgtcgtacctaactaactctaggttagaacgtagtcccggaaattgaaacctaaatcccgtaaaagtaaccggaaanaacccgttaagaaacccgtaaagaaacccttacggtttacccaccctggaccgaagtcctacgtacccttacggtcgtaaacgtacccccggttaccgaaaggggtaccgtaacccggggttagttaaaccttaacggtttacgaagggttaacggaaaccgtttaccggacccccttaagtaaaccg

SEQ ID NO: 431558 - DNA, 752 bp, Homo sapiens
  misc_feature: GZ8MTXP02HHPNB.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctccacaaggtgtcctgtcaacaagtacagctgcagcagtcaggtccaggactggtgaacgccctgcacgaccctctcgctcaccgtgcgcctagtccggtacccggggaacaggaggtccgactacgcgaacgtagttgttcgcgtttggactacggttcgggtacaacgggtccacggttccccagttaccgggaaaggtacggtaccgtaaagggttacggcggggttaccgagggggtaaaaggaccttaggttcttttaacgagttaccggtaccctaaacggtagtaaacgggtaaaacttaacctaaaagtttacgtacccgaaccgtaaaccctagtttaccggttacggttaagggacgttaacggacccggtaaacttaggaaaactttaacgtaaccgtaaaaccggtaggaaaccttacgtaaacgtacgaaaacgttaaacccggtacgtttaccccgaccgtacgacgaacgtccgttacgtaccgttcgtacggttaccgaaccggtaccggtaacgttacggtaacgttagttaacttaacggttacgtaacgggaacggaacccgtaccggtaacccgtagaaccg

SEQ ID NO: 431559 - DNA, 728 bp, Homo sapiens
  misc_feature: GZ8MTXP02F2NZI.19.71.G05.1.454.CMB.2.raw
  modified_base (559)..(559): a, c, t, g, unknown or other
  modified_base (567)..(567): a, c, t, g, unknown or other
tcagtactctcgtgcacgaccggtgctcgatttagtgtcgtcgcaagagagaggggggcagagtctgctgaattctggctgaccagggcagtcaccagagccccagacaatgtctgtctccttcctcttcttcctgcccgtgctgggcctcccacaaggtgtcctgtcacaagtcagctgcagcagtcaggtccaggactggtgaacgccctgcacgaccctctcgctcacctgtcgcctatcgtaccggggacagagtcgctagcgacagtgttgccgttgcgtacgtgggtacaggcctacgtccccgagtacggaggtacggtctaggagggtggtacggttaggggaaacggtactagtttactttacagttacgtacccgaacgtacgggttaggaaaacgttaaactaaagtttaacgtacgaccctaaaccgtatttaccgtaggtttaacggagttaacgggtacgtaaaccgttggaaacccttaagacctaaagggttacaaacgaacgtaacgttaaccgaaacgttaaacccgttagtttacccccnccggttanaccggtacggtacccttaacgtaccgtcgtttacggaccggaaacccggtttaccggggaaacggtaccgttaacggggtttacttaaacggtttaacgtttaacggtaacgggtaaaccggggtaaacggtccccggtaacccttaaggtaacgtaaccg

SEQ ID NO: 431560 - DNA, 561 bp, Homo sapiens
  misc_feature: GZ8MTXP02G8BP3.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcacgtccccatcgagaggtctagagtggctaggggaagacatatttcattgtaccaaacgacgtaggaaactaactaaattatacgacacctaatctgttagagagtcgatagactaaatacaaacgtagaacacgaatacgaaagaacctacgttcctaccctgaccagtctacgacctcgtagtacgaccgtacccgaggtacgacgggtagtagtattacgtggtaggaaacggaccggtccccaaagtacgaaccatcgaaccacctcggtctcgtcggtactacttaag

SEQ ID NO: 431561 - DNA, 558 bp, Homo sapiens
  misc_feature: GZ8MTXP02JKK3S.19.71.G05.1.454.CMB.2.raw
  modified_base (224)..(224): a, c, t, g, unknown or other
  modified_base (303)..(303): a, c, t, g, unknown or other
  modified_base (485)..(485): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctntcgctcacctgtgccatctccggggacagagtcgctagcgacagtgtgcttggcatgggtcaggcagtccccatcgagngtcagagtggctggggaagcagtcttcattcgtcaaacgacgtggaaacttacgaaattatcgacacccgaaagttcgtgttaggagtaacggtcgacgttagtaaccaaacgtcgtaaacgtagacaaccaaggttacccgaaaggtaaccaacgtttctccctagccagctagcccttcncgtacgacgtaccggacgacgtacggttatagttaacgttactacggtacggaacggaccgtacccaagtacg

SEQ ID NO: 431562 - DNA, 769 bp, Homo sapiens
  misc_feature: GZ8MTXP02FRVVZ.19.71.G05.1.454.CMB.2.raw
  modified_base (155)..(155): a, c, t, g, unknown or other
  modified_base (205)..(205): a, c, t, g, unknown or other
  modified_base (226)..(226): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccanaaggtgtcctgtcacaagtacagctgcagcagtcaggtccaggactggtnaacgccctcgactagaccctntacgctcacctgtcgccagtcgtccggggacagtagtcgcgtagcgaactggtgttcgaccgttggcctaacggttggacagggcctaacggtccccagttaccgaggtacggtctaaggaggttggacgtagggggtaaacatagttactttacgaagttcggtacccaaagtcggttaagaaaactttaccgtaaaagtttacgacgtacctaacgtagttacgtaggttacggaagtacgtaccgtaacgttaaacgtaactaaaacgttacccggtaaaacgtacgaaaaccgtaaaccgtaacgttaaaacccggtaaaaccggtaaacccgtttacgttaccccgttaacccgtacggtaacccgtaacggttaccgttaaaccggttccctttaacgggtaccggttaaacccggttaacccggtaaacccgggtaacggtaaaccggtttacgggttaaacgtttaaccgttaacggttaacgtaacggggtaaaccggtaaacccggtaaccccggtaaccttaaaaggtaacg

SEQ ID NO: 431563 - DNA, 651 bp, Homo sapiens
  misc_feature: GZ8MTXP02FS0VO.19.71.G05.1.454.CMB.2.raw
  modified_base (223)..(223): a, c, t, g, unknown or other
  modified_base (253)..(253): a, c, t, g, unknown or other
  modified_base (310)..(310): a, c, t, g, unknown or other
  modified_base (323)..(323): a, c, t, g, unknown or other
  modified_base (640)..(640): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctcgggcctcccacaaggtgtcctgtcacaagtcagctgcagcagtcaggtccaggactggtcgaagccctgcacgtacccnctcgctcaccctgtgccatcgtccgggganagagtcgctagcacagtgttgacgttggcagtgggtcaggcacgtccccgatcgagngtcgtagagtggngtagggaacgacgtatattcgagtacgtcacgacgtaggaaataaccaatttatcgacctaccagttccttaggttacgaagtagttaccgaacttacgaacctaaactaacctaaacggtaacggtaaaccaacgtaaaccgtaagtaaaacccggtaaacccttaacggtttcccctaaccccggtgaccgttaaacggcctttaccgggacctttaccgtcgttacgacccgttacccccgggaggttaaacccgtaccgggggttattacgttacgttaaccgtaggggtacggaacggacccgaccccgtanaaccggtaacg

SEQ ID NO: 431564 - DNA, 601 bp, Homo sapiens
  misc_feature: GZ8MTXP02G314E.19.71.G05.1.454.CMB.2.raw
  modified_base (201)..(201): a, c, t, g, unknown or other
  modified_base (220)..(220): a, c, t, g, unknown or other
  modified_base (233)..(233): a, c, t, g, unknown or other
  modified_base (409)..(409): a, c, t, g, unknown or other
  modified_base (443)..(443): a, c, t, g, unknown or other
tcagtactctcgtgcacgaccggtgctcgatttagtgtcgtcgcaagagagaggggagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtnaagccctcgcagacccctntcgctcactgtcnccatcgtcggggacagcgtcgctagcgacagtgttgcttggcacgtgggtcaggccacgtccccagtcgagtaggtacaggagttggaccgtaggggaaccgtacctagtttactttacggattacggttaccaaggtacgtagggaaaccttagaaaattcgacacgtacaactntagtagagagtcgactagaacaatacgaacgaanactacacgttacgaacgaacgtactaccgtacctcggtactaacggtctacgacctcgtacgtacgtacccttaccggggggaacacggttaccgggtacgttaacgttacgttaacgtagtaacggtaacgtaccggaccccgtaaggtactaaccg

SEQ ID NO: 431565 - DNA, 731 bp, Homo sapiens
  misc_feature: GZ8MTXP02G8C3U.19.71.G05.1.454.CMB.2.raw
  modified_base (156)..(156): a, c, t, g, unknown or other
  modified_base (255)..(255): a, c, t, g, unknown or other
  modified_base (362)..(362): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctcccttcctcttcttcctgcccgtgctgggcctcccanaaggtgtcctgtcacaagtacagctgcagcagtcaggtccaggactggtgaagccctcgcacgaccctctcgctcacctgtgcccagtcgtccgggganagacgtcgcgtagccgacgtagttcttgcgttagcacgtgggtcaggcacgtccccagtccggagtgtccgtagtacgtgggacgtggggaaacgctataacgtttnagttcgtccgaaacgtcggtaaggaaacttaaacgaaaatttagtaacgtacccgaacgttacgttacgttacggtttaagaagtacggttaccggaaacgttcgtaaaaccgacgttaaccggaaaccgtaaacggaaacaccgtaaagaacccggggtaaaaacgtaaacccgttaccggttaacccgtttacccgtaacgtacccgtaccgggttacttaaaccgggtaaccccctttaggttccgtacggttaaaccccggttaccgggaaacggttacccgggtaacggggtacgtttaaacgtaacgttttaacgcggggttaaaacggaaccggtaacggtacccccggaactttaaaacgg

SEQ ID NO: 431566 - DNA, 784 bp, Homo sapiens
  misc_feature: GZ8MTXP02GEI8J.19.71.G05.1.454.CMB.2.raw
  modified_base (159)..(159): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctccacaaggtntcctgtcacaagtacagctgcagcagtcaggtccaggactggtcgaacgccctgcacgtaccctctcgctcacctgtcgccagtcgtccggggacaggagtcgcgtacgcgtaacaggttgttcgcgtttggaccacggttcgggtacacgggcctaacggtccccctaagtaccggaggaacggttcgtaaggtacggtggaccggttaggggaaacgaccttaattacggttttacaagttacgtaccccgtaaagtacgggttaggaaaacttaaccgtaaaagtttactaacggaccctaaccggttaatttaccgtagggtttacggaacgtacggtcccgtaaagttacggaaactaaaacgtccgttaaaaaccggtaacgtaaacctaacgtaaccgtaaaccggtaaaacgttaacccgttaccgtttacccgtaccgtaggtaccgtaacgtccggttaaccgtaaccctttacgggtaccgggttaacccgttaaccccgggaaaccgggtaacgggtaaccggttaggggtttaaccttaaacgtttaacgggttaccggtaaacgggtaaccggggtaaaccggttaccccggaaccgttaaacggtaaacg

SEQ ID NO: 431567 - DNA, 642 bp, Homo sapiens
  misc_feature: GZ8MTXP02HG6OQ.19.71.G05.1.454.CMB.2.raw
  modified_base (225)..(225): a, c, t, g, unknown or other
  modified_base (236)..(236): a, c, t, g, unknown or other
  modified_base (245)..(245): a, c, t, g, unknown or other
  modified_base (247)..(247): a, c, t, g, unknown or other
  modified_base (255)..(255): a, c, t, g, unknown or other
  modified_base (258)..(258): a, c, t, g, unknown or other
  modified_base (266)..(266): a, c, t, g, unknown or other
  modified_base (302)..(302): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctctgggcagcgggccacatcaactgcaaagtcagccanaatcttttaanacatacaananacgaaatntanctagacancagagacagacagcctcgagctgctactatttacgnggcatccgtaaccgggatcccggggtcccctaggtaccgtattcgaggtcggacgacgggttcgggtctacggggaactagtactttccacttctacgaaacataccgaggtccacggtccctacgacgacggtacgtagaacgacgtaggtacggtacgttacgtttaacgtttaagttacgttaacgtaaacttaaacttaaactttaactttaacgtttaacgttacggttacggtaccggttaccggtaaccggtaaaccggtaaaccggtaaacggtacggtaacgtaacgtaacgtaacgtaaacgtaacgtacggtacggtacgtacgtaccg

SEQ ID NO: 431568 - DNA, 659 bp, Homo sapiens
  misc_feature: GZ8MTXP01A9LWH.8.5.A05.1.454.CMB.2.raw
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaattgttggtacctacagggtatactggtaaccaaacagaagccgagggacgtccctccccagaatcctcctggtataacaatcagactcagataggcagcaggcctcgtcggactcccagcccgtccttctcgtggactacccgaaaagtcttcgccgttacgggaccctaaagtcggaccgtaaggggttactttttaaccgcgtaacgtttcccgttacggttccgggggtaccttacccgaaggtacggttacggaccggggtagttagggaacggtccttaaggtaacctttagtttaccgttaggtactttaggtaacgttttcgggacaaactaacgcggtcggttccgtttagggggtcggttaccggggcgggaaccggggtaaccaaggtccgtaccggtacccttaccggtaacggttcccgaacccgg

SEQ ID NO: 431569 - DNA, 659 bp, Homo sapiens
  misc_feature: GZ8MTXP01B7G4M.8.5.A05.1.454.CMB.2.raw
  modified_base (365)..(365): a, c, t, g, unknown or other
  modified_base (381)..(381): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaattgttggtacctacgagggtatactggtaaccaacgagaacgccgagggacgtccctccccaagaactctcctaggtaactaacaaatcaagactacgagataggcagcgacggcctcgtcggaccgtcccagcccgtctttcnctggactaccgaaagntcgccgttacggacctaagtgacgtaagggttacttttacctctacttccgtcgtcgggacctaccgaaggtacgttaggaacgggtagttgggaacggtccgttagtaaccgtttaatttaccgttaggttaaagttggtaacgtttcggacctaaacgtaaacgttcggtcggttccggtttagggggtcggttaccgggggcggggttaaccggggaaccctaaacggtcccgtaccggtacccccgttaccggtaaccggggttccaacccggg

SEQ ID NO: 431570 - DNA, 564 bp, Homo sapiens
  misc_feature: GZ8MTXP01B77PN.8.5.A05.1.454.CMB.2.raw
  modified_base (330)..(330): a, c, t, g, unknown or other
  modified_base (377)..(377): a, c, t, g, unknown or other
  modified_base (499)..(499): a, c, t, g, unknown or other
tcagctcgcgtgtccacgaccggtgctcgatttagatagatagacagggtctccgaaggcttcaccagtcctgtcccagctgcagctgcgtgagtcgggcccaggactggtgaagccttcggagaccctgtcgctcacctgcattgtctctggtggctccgtcagcagtagtaattattattgggctggatccgccagtccccggaagggctggagtggattgggagtgtcttcgataatgggtacacttacaacaaccgtcctcaagagtcgagtcaccatatcaagtaaacacgtaccaaagaaccagttctccctggacttgacctntgtgaccgcgcggacacggtcccgtttactattgtgcgaaggagggngatagtgaagtagcaccactccgtcgtcttcgactcccgtggggccgtcggccacccgtggtcacgtgtcctccgtcacgtcctccaaccacggcccagtccggtccttccccgtggtcccnccctcctccaacgcgcgaccgtcgcggggcacgaagccgccgtcggcttcgtccgttggtaaccg

SEQ ID NO: 431571 - DNA, 668 bp, Homo sapiens
  misc_feature: GZ8MTXP01A35V3.8.5.A05.1.454.CMB.2.raw
  modified_base (233)..(233): a, c, t, g, unknown or other
  modified_base (253)..(253): a, c, t, g, unknown or other
  modified_base (272)..(272): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtgcatcaatgttggtacctanagggtatactggtaaccaanagaagccgagggactcccncccagaactcctcctggtaatacaaatcagactacagatacggcagacaggcctcgtcggacctcccgagtcccgtcttcctcgtggactaacccgaaagtcgtcgtccgtttacgggacctaagtcggaccgtaagggttactttttaccgacttaacgttcgttcggtcgggtcctaccgtaaggtacggttacggacggggtagttgggaacgtcgttacggtaacttagtttaacgttagttacgttaggttacgtttacggcctaaacgtaacggttcgggtcccggttcgggtttgggggttacgggttaccgggggacggggacgggtaacccgtacgggtaaccgtacccggtaccccgttaccggtaacgggttcccgtaacccggg

SEQ ID NO: 431572 - DNA, 616 bp, Homo sapiens
  misc_feature: GZ8MTXP01AZ516.8.5.A05.1.454.CMB.2.raw
  modified_base (182)..(182): a, c, t, g, unknown or other
  modified_base (254)..(254): a, c, t, g, unknown or other
  modified_base (354)..(354): a, c, t, g, unknown or other
  modified_base (411)..(411): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagcccggcttccctctctgcatctcctggancatcagccagtctcacctgcaccttgcgcagtggcatcaatgttgtacctagagggtatactggtaaccaanagaacgccgagggactccctaccccagaactctcctaggtataacaaatcaagactcagataggcagcacggcctcgtcggacctcccagtcccgcttcncgtggactaccaaagcgtcgtcgttcggaccaagtcgacgtagggttacttttaccnctactcgtcgtcggacctacgaagtacgtacgacggtagtcggacgtctagtaacttagttacgtagttagttagtacgttcggaacctaacgtaacgttcggtcggttcgggtttacgggggttcggttaccgggggacgggttaaccggaaccgtacggtcccgtacccggtaccccgttacggtaacggttaaccgaaccgg

SEQ ID NO: 431573 - DNA, 661 bp, Homo sapiens
  misc_feature: GZ8MTXP01BA18D.8.5.A05.1.454.CMB.2.raw
  modified_base (253)..(253): a, c, t, g, unknown or other
  modified_base (455)..(455): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtgcatcaatgttcgtacctagagggtatacgtggtaccaanagaacgccgagggactccctacccagaactcctaccgtaggtaactaacaaatcaagtactacgaagaagtacggcaggaccgacgggtccctacgtaccgggtaccgtccccgagtcccgtctttccgtcgttaacggactaaccgaaaagtcttcgtccgttacggacctaagtcggaccgtaagggttacttttaaccnctacgttcgtaccggtcggacctacgaaggtacgtacgaacgggtagtacggacgtacgttaagtacttagttacgttagtagttagtagttcgaactaacgtacgttcggtcggttcgggttgggtacggttacggggacgggttaaccggtaaccgtacggtcccgtaccgtacccgttacggtaaccggttaaccgaacccgg

SEQ ID NO: 431574 - DNA, 521 bp, Homo sapiens
  misc_feature: GZ8MTXP02H9JSQ.8.5.A05.1.454.CMB.2.raw
  modified_base (181)..(181): a, c, t, g, unknown or other
  modified_base (346)..(346): a, c, t, g, unknown or other
  modified_base (359)..(359): a, c, t, g, unknown or other
  modified_base (392)..(392): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggancatcagccagtctcacctgcacttgcgcagtgcatcaatgttggtacctagaggtatactggtaccaacagaagccaggacgtcctcccaagaatctcctggtataacaaatcaagactcaagataggcagcgtaggcctcgtcggaccgtccccagccgcttcnctgataccaaagntacgcgttcgaccaaatgcgaaggtactttacnctatctcgtcggctcgagagtgacgagtgagtctagtactattactgtatgtagtttcgactacgaagacgcgtagttgggtcgttcgggacggacggaacgaaggctacgaccctcgacgtacaccgg

SEQ ID NO: 431575 - DNA, 586 bp, Homo sapiens
  misc_feature: GZ8MTXP02IVA8R.8.5.A05.1.454.CMB.2.raw
  modified_base (181)..(181): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggancatcagccagtctcacctgcaccttgcgcagtgcatcaatgttggtacctagagggtatacgtggtaaccaacgagaagccgagggactccctaccccagaactcctccgtaggtaactaacaaatcaagactcaaagataggacagacaagcctgtcggaccgtccccagcccgtcttctcgtggaactaccgaaaagtctcgtacttaccggacctaaagtcgacgtaagggttacttttacctctactcgtacgtcgggcctaccgaagtagtgacgtagtggaggtctagtaacttattacgtagttagtgtagttgactaacgaacgagtcgtggttcggggtcgttacgggacgggaacggaaccgaacgtcgtaccgacccgtcgtacggtcaaccgg

SEQ ID NO: 431576 - DNA, 588 bp, Homo sapiens
  misc_feature: GZ8MTXP02FW6XQ.8.5.A05.1.454.CMB.2.raw
  modified_base (424)..(424): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaattgttggtacctacgagggtatacgtggtaaccaacagaagccgaggggacgtccctaccccagaactcctccgtaggtataacaaatcagactcagataggcagcaggcctcgtcggactcccccagccgtcttctctgggaactaccgaaaaggactcgcgttaccggacctaaagtcgacgtagggttaacttttacctntacttctcgttgggcctacgagtagtgacagtgacggtctagtacttagttatggttatgtatttacggctaaacgacgtaggtcgtcggttggggtacgttcggggacgggaacggtaacccgaagtccgtaccggtacccctttacggacggtcgaacccgg

SEQ ID NO: 431577 - DNA, 583 bp, Homo sapiens
  misc_feature: GZ8MTXP02FF51S.8.5.A05.1.454.CMB.2.raw
  modified_base (325)..(325): a, c, t, g, unknown or other
  modified_base (367)..(367): a, c, t, g, unknown or other
  modified_base (411)..(411): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtgcatcaatgttggtacctacagggtatactggtaaccaacagaagccaggggactccctaccccagaactctcctggtatacaaatcaagactcagataggcagcaggcctntcggacgtcccccagcccgtcttctcgtggactaccaaaagntcgccgtttacggacctaaagtcgacgtagggttactttttacnctactctcgtcgggtcctccgagagtgacgagtgaggctagacttattactgtatgtagtttcgactaacaaacgagtcgtcgtttggggttcggttaccgggacggggtaaacggggaacccgtaaaggtccgttaccggtaccccgttaccggtaacggtccgaaaccgg

SEQ ID NO: 431578 - DNA, 534 bp, Homo sapiens
  misc_feature: GZ8MTXP02H4H1Z.8.5.A05.1.454.CMB.2.raw
  modified_base (359)..(359): a, c, t, g, unknown or other
  modified_base (392)..(392): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttggtacctacagggtatactggtaccaacagaagccagggacgtcctccccagaatctcctggtatacaaatcagactcagataggcagcaggcctcgtcggactcccccagccgtcttctctggactccaaagntcgcttcggaccaagtgacgagggtattttacnctatctcgtgggctccgagagtgacgagtgagctgactatactgtatgtatttggactaacgacgagtccgtcggttggggttcgttccggggacgggacgggaaccgaaggcctcggaccctccggtacggtcgaacccgg

SEQ ID NO: 431579 - DNA, 549 bp, Homo sapiens
  misc_feature: GZ8MTXP02IHXXS.8.5.A05.1.454.CMB.2.raw
  modified_base (251)..(251): a, c, t, g, unknown or other
  modified_base (351)..(351): a, c, t, g, unknown or other
  modified_base (366)..(366): a, c, t, g, unknown or other
  modified_base (398)..(398): a, c, t, g, unknown or other
  modified_base (472)..(472): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtgcatcaatgttggtacctacaggtatactggtaccaanagaaagccagggactccctaccccagaactcctcctaggtataacaaatcaagactacagataggacagcaggcctctcggaccgtccccagccgcttcnctggactaccaaagntcgcgttcgaccaaagtgcgtaggtatttacnctatctcgtggctacgagagtgacgagtgagactagacttattagtgttaatgtagtttcggactaactaacgngtcgttcggttgggtcgttccgggagggacggaaccgtaacggtactaccgacccgtaccgtacggtaccgaaccgg

SEQ ID NO: 431580 - DNA, 590 bp, Homo sapiens
  misc_feature: GZ8MTXP02IMYGI.8.5.A05.1.454.CMB.2.raw
  modified_base (181)..(181): a, c, t, g, unknown or other
  modified_base (313)..(313): a, c, t, g, unknown or other
  modified_base (353)..(353): a, c, t, g, unknown or other
  modified_base (371)..(371): a, c, t, g, unknown or other
  modified_base (414)..(414): a, c, t, g, unknown or other
  modified_base (506)..(506): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggancatcagccagtctcacctgcaccttgcgcagtgcatcaattgttgacctacgagggttatactaggtaccaaacagaacgccgagggacgtccctccccaagaactcctcgtagtataacaatcaagactanagactaggcagcaggcctgtcggacctcccagcctcttcncgtggactaccaaaggtntcgtacgtttcggacctaagtcgacgtaaggttacttttaccncgtattccgtacgtcgggtctaccgagtagtacgagtagtggaagtctagtacttagttacgtggttatagttacgttagactaaacaacgnggccgttcgggttggtcggggtttacgggacggtaacgggaactaacggtccgttaccggacccttacggtacgacgaacccgg

SEQ ID NO: 431581 - DNA, 639 bp, Homo sapiens
  misc_feature: GZ8MTXP02JLKOE.8.5.A05.1.454.CMB.2.raw
  modified_base (181)..(181): a, c, t, g, unknown or other
  modified_base (367)..(367): a, c, t, g, unknown or other
  modified_base (415)..(415): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggancatcagccagtctcacctgcaccttgcgcagtggcatcaattgttgtacctagagggtatactggaaccaacgagaaagccgaaggggacgtcccctaccccaagtaactcctaccgtaggtaactaacaaaatcaagacctcaagtataggcagcgacggcctgcggactccccagccgtcttcnctggactacgaaagctcgctcgactaagtgacgtaggttactttaccnctactcgtcgtcggctacgagtacgtacgaacgtagtggacgtcgtaacgttaacttaagtttacgtagttattagttagttacgaacctaacgtaacgtacgggttaccggttacgggtttacggggttaccgggttaccgggggaacgggtaaccgggtaaccgtaaccggtaccggttacccggtaaccccgtttaccgggtaacggtacccgtaaccggg

SEQ ID NO: 431582 - DNA, 590 bp, Homo sapiens
  misc_feature: GZ8MTXP02GEG0K.8.5.A05.1.454.CMB.2.raw
  modified_base (181)..(181): a, c, t, g, unknown or other
  modified_base (411)..(411): a, c, t, g, unknown or other
tcagctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggancatcagccagtctcactgctaccttgcgcagtgcatcaattgtgtacctagaggtatactggtaaccaacagaacgccgagggactccctacccagtaactctccgtagtaataacaaatcaagactcagaataggcagcagcctgtcgactccccgagccgtcttcctcgtggactaaccaaaagtctcgtacgttaccggactaaagtcgacgtaaggttactttacnctatcctcggtcggtctaccgagtagtacggacgtagtaggacgtacgtagtaacttagttacgttagtaagttgtaagtttcggacctaaacgtacgtaggtcgttcggttagggtcggtacgggacgggtaggaaccgtaagccgtacgtaccctacggtacggtaccaacccgggg

SEQ ID NO: 431583 - DNA, 556 bp, Homo sapiens
  misc_feature: GZ8MTXP01BGWUT.39.73.G07.1.454.CMB.2.raw
  modified_base (256)..(256): a, c, t, g, unknown or other
  modified_base (288)..(288): a, c, t, g, unknown or other
  modified_base (308)..(308): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggnggctccagtccaaccccaanactggcgacacaaactctgcacagaactttcagggcagggtccaccatcgacccgggacaaccgtccaatcaaatacagcctacatggaactcagtagacgtaaaatctagacgacacggccgtactattactgtggcgagacggcaggacgttccgacgtgggggataaggtgcgctaatttcgatggttctttgattagttcgttggggccaaggggaacaagtggttacctaaccggttcttccg

SEQ ID NO: 431584 - DNA, 561 bp, Homo sapiens
  misc_feature: GZ8MTXP01B739D.39.73.G07.1.454.CMB.2.raw
  modified_base (255)..(255): a, c, t, g, unknown or other
  modified_base (306)..(306): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtccctgccaggcttctggatacatcttcaacgtctattacatccactgggtncgccaggcccctggtcaagggcctgagtgggtggctccagtcaaccccaanactggcgacacaaactctgcaacagaactttcgaggcagggtcccacatcgacccgggacaaccgtccaatcaaatacagcctacatcggactcagtagacgtaaaatctagacgacacggccgtactattactgtggcgtaggagcgagacgttcccagttggggataaggtgcgctaattcggattgttcttttagattagttcgttaggggaaccgaaggggaactaagtggttacctaaccgttcttcccg

SEQ ID NO: 431585 - DNA, 547 bp, Homo sapiens
  misc_feature: GZ8MTXP01BDA8T.39.73.G07.1.454.CMB.2.raw
  modified_base (256)..(256): a, c, t, g, unknown or other
  modified_base (306)..(306): a, c, t, g, unknown or other
  modified_base (364)..(364): a, c, t, g, unknown or other
  modified_base (372)..(372): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggtggctccatcaaccccaanactggcgacacaaactctgcacagaactttcaggcagggtcccaccatgacccggganaacgtccntcaaatacagcctacatggaactcagtagacgtaaaatctagacgacacggccgtctattactgtggcgagagcagagttcgacgtggggataaggtgcgctaagtttcgatgttcgtttgattagttcgttggggcctaaggggaacaagtgggttactaaccggttcgttccg

SEQ ID NO: 431586 - DNA, 590 bp, Homo sapiens
  misc_feature: GZ8MTXP01DPDU7.39.73.G07.1.454.CMB.2.raw
  modified_base (256)..(256): a, c, t, g, unknown or other
  modified_base (371)..(371): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggtggcgtccatcaaccccaacactgcgacacaaactctgcaacagaactttcgaggcagggtccacatcgacccggacaacgtcntacaaatacagccctaacatacggaactacaagttaacgacgtaaaattcagacgaacgacggaccgtctaattaaccgtgttacggcgaggaggccaaggacgttcccgaacgttaggggataaaggtgcggactaagtttcggattcggtttcgtttagtattacgttcggttacgggaacgaaggaacgtaacgtcgttaccgtaaccgttcgtcg

SEQ ID NO: 431587 - DNA, 559 bp, Homo sapiens
  misc_feature: GZ8MTXP01D1AT9.39.73.G07.1.454.CMB.2.raw
  modified_base (256)..(256): a, c, t, g, unknown or other
  modified_base (310)..(310): a, c, t, g, unknown or other
  modified_base (392)..(392): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctggagtgggtgggctccgatccaaccccaanactggcgacacaaactctgcacagactttcagggcagggtccaccatcgacccgggacaacgtccaatcaaatacagcctanatcggaactcagtagacgtaaatctagacgacacggccgtactattactgtggcgagagcagcgtccagtaggggataagtgcgctaatttcgattggttcttttggattagttcggttacgggggccaaaggggaactaagtcggttacctaaccggttctttccg

SEQ ID NO: 431588 - DNA, 558 bp, Homo sapiens
  misc_feature: GZ8MTXP01ANK9Z.39.73.G07.1.454.CMB.2.raw
  modified_base (288)..(288): a, c, t, g, unknown or other
  modified_base (324)..(324): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtgcgccaggcccctggtcaagggcctgagtgggnggctccatcaaccccaacactggcgacacaaactcngcacagaactttcgagggcagggtccaccatggacccgggacaaccgtcccaatacaaatacagcctacatcggaaactcagtagacgtaaatctagacgacaacggccgtactattactgtcggcgagaggacagtacgttcacgtgggggataaggtgcgtctaacgtttgatggttcttttgattagttcgttaggggccaaggggtaacagtcgactaaccgttcgtccg

SEQ ID NO: 431589 - DNA, 555 bp, Homo sapiens
  misc_feature: GZ8MTXP01A3TP0.39.73.G07.1.454.CMB.2.raw
  modified_base (256)..(256): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggtgggctccatcaaccccacactgcgacacaaactctgcacagtacttcagggcagggtcccaccagtcgacccgggacaaccgtccaatcaaatacacgcctacatgaactcagtagacgtaaatctagacgacgacggcgtctatactgtggcgagagacagcgtccgacgtaggggataaggtgcgctaagttcgattgttcgttttgattagttcggttcggggaaccgaagggaacaagtggttacctaaccggttcttaaccg

SEQ ID NO: 431590 - DNA, 528 bp, Homo sapiens
  misc_feature: GZ8MTXP01E05MT.39.73.G07.1.454.CMB.2.raw
  modified_base (256)..(256): a, c, t, g, unknown or other
  modified_base (470)..(470): a, c, t, g, unknown or other
  modified_base (479)..(479): a, c, t, g, unknown or other
  modified_base (484)..(484): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgcaggcccctggtcaagggcctgagtgggtggctccagtccaaccccaacactggcgacacaaactctgcacagaactttcaggcaggtcaccatgacccggacaacgtccaatcaaatacagcctacatggaactcagtagacgtaaaatctagaacgacacggcctctattactgtggcgagaggcagagtccagtggggataagtgcgcnttgatgttntttgnttagttgttggggccaagggcaagtcggttacaaccgttcgtcc

SEQ ID NO: 431591 - DNA, 628 bp, Homo sapiens
  misc_feature: GZ8MTXP01BWQGY.39.73.G07.1.454.CMB.2.raw
  modified_base (256)..(256): a, c, t, g, unknown or other
  modified_base (288)..(288): a, c, t, g, unknown or other
  modified_base (309)..(309): a, c, t, g, unknown or other
  modified_base (328)..(328): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgcacggcccctggtcaagggcctgagtgggnggcgtccagtccaaccccaanacgtggcgacacttaaacnctgcacagtaacctttcgaggggcagggtcccacctatcggacccgggacaaaccgtccaatcaaatacacgcctacagtacggactacagtaagacgtaaaatctacggaaccgacgacggacccgtctaacttactggtggacggaggaaggccgagaacgttccgacgtagggggaataaggtcgccggtataagtttacggttaattcggtttacgtttagtaacgttacgttcggttacggggtaacggtaacgggtaacggtaacggtacggttaccgtaaccgttccgttccg

SEQ ID NO: 431592 - DNA, 599 bp, Homo sapiens
  misc_feature: GZ8MTXP01EKXVR.39.73.G07.1.454.CMB.2.raw
  modified_base (257)..(257): a, c, t, g, unknown or other
  modified_base (280)..(280): a, c, t, g, unknown or other
  modified_base (285)..(285): a, c, t, g, unknown or other
  modified_base (289)..(289): a, c, t, g, unknown or other
  modified_base (300)..(300): a, c, t, g, unknown or other
  modified_base (391)..(391): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctgatacatcttacaacgtctattacatccactgggtncgcaggcccctggtcaaggctgngtggnggcncatcaacccanacgtgcgacacaaactctagcacagtaactttcgaggcagggtaccaccgatcgacccggacaacgtacaatacaaatacagacccctaanagtacgaactagaagtaacgaacgtaaatacgtaacgaacgaccgacgtacgtactaattacgtgtacggagaggagacgacgtacgtacgtaggtagggaagtagtcgtcgtcttaagttcgttagttcgttacgtttagtagttacgttcggttacgggtaacggtaacggaacgtaacgtacggttaccgtaaccgttcgtaacg

SEQ ID NO: 431593 - DNA, 538 bp, Homo sapiens
  misc_feature: GZ8MTXP01D8WZB.39.73.G07.1.454.CMB.2.raw
  modified_base (256)..(256): a, c, t, g, unknown or other
  modified_base (475)..(475): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggtggctccatcaaccccaacactgcgacacaaactctgcacagaactttcaggcagggtccaccatcgacccggacaaccgtccaatcaaatacagcctacatgaactcagtagacgtaaaatctagacgacacggccgtactattactgtaggcgagaggcagagttccagtaggggataagtgccgntaatttcgatgttgttgtattagttcgttcggaacgaaggaacgtagtcgttcgtcgttcgtc

SEQ ID NO: 431594 - DNA, 553 bp, Homo sapiens
  misc_feature: GZ8MTXP01BGDFC.39.73.G07.1.454.CMB.2.raw
  modified_base (256)..(256): a, c, t, g, unknown or other
  modified_base (390)..(390): a, c, t, g, unknown or other
  modified_base (445)..(445): a, c, t, g, unknown or other
  modified_base (476)..(476): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccacggcccctggtcaagggcctgagtgggtggctccatccaaccccaacactggcgacacaaactctgcacagaactttcgaggcaggtccaccatcggacccggacaacgtcaatacaatacacgcctanataggaactcgagtagacgtaaatctagacgacacggctctatactgtggcgagngacgagcgtccgagtaggggataaggtgcgntaatttcgatgttcgtttagagttagttcgttaggggaaccaagggaacctaagtcggttacctaacggttcttccg

SEQ ID NO: 431595 - DNA, 691 bp, Homo sapiens
  misc_feature: GZ8MTXP01AU6LO.39.73.G07.1.454.CMB.2.raw
  modified_base (257)..(257): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggaagcctggggcctctctgaaacgtcccctgccaggcttctggatacatcttcaacgttctattacatccatgggtncgcacggcccctggtcaagggcctgagtgggtggctccatccaaccccacacgtggcgacacaaactctagcaacagtaactttcgagggcacgggtccaccgagtcggaaccccgggacaaccggttacccaagtacaaacttaccacgaccctaacgatacggaactacgaagtaacgacgttaaaaatcgttaacggaacgaacgaccgggtaccgttacttaagtttaccgtggttacgggacggtaagggacggacgtaacggtaacggtttacccgaacgggttacgggggtaaagttaaacgggtcggtaccgtaccgttaagttttccgggttaagtttcgttaccgttttagaacgtttacgttcggttacgggggaacctaaaggggtaactaaaggtcgggttacctaaccggttcttaaccg

SEQ ID NO: 431596 - DNA, 534 bp, Homo sapiens
  misc_feature: GZ8MTXP01AY6N4.39.73.G07.1.454.CMB.2.raw
  modified_base (256)..(256): a, c, t, g, unknown or other
  modified_base (285)..(285): a, c, t, g, unknown or other
  modified_base (467)..(467): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgcaggcccctggtcaaggcctgagtggnggctccatcaaccccaacactggcgacacaaactctgcacagactttcaggtcagggtccaccatgacccgggacaacgtccaatcaaagtacagcctacatcggaactcagtagacgtaaaatctagacgacacggcctcgtattactgtaggcgagagcgagagtcacgtgggatagtancgcaatttcgatgttcgtttgattagttcgttgggccaaggcaagtgggttactaacgttcgttccg

SEQ ID NO: 431597 - DNA, 573 bp, Homo sapiens
  misc_feature: GZ8MTXP01AS39E.39.73.G07.1.454.CMB.2.raw
  modified_base (393)..(393): a, c, t, g, unknown or other
  modified_base (402)..(402): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagcccccctcccaggtgaaattggtgcagtctggctttgaggtgaggaagcctggggcctctctgaaagtcccctgccaggcttctggatacatcttcaacgtctattacatccactgggtgcgccacggcccctggtcaagggcctggagtgggtggctccatccaaccccacactggcgacacaaactctgcacagaactttcgagggcagggtcccaccagtcgacccgggcaacgtccaatcaaatcagcctanatcgaactnagtagacgtaaatctagaccgacgacggccgtactattactggtggcggagaggcaggtacgttccgaacgttggggaataaggtcgcgctaatttcgattcgttcgttttagaattgttcggttacggggaaccaagggaactaagtggttacctaaccgttcttaaccg

SEQ ID NO: 431598 - DNA, 549 bp, Homo sapiens
  misc_feature: GZ8MTXP01BRMKX.39.73.G07.1.454.CMB.2.raw
  modified_base (257)..(257): a, c, t, g, unknown or other
  modified_base (448)..(448): a, c, t, g, unknown or other
  modified_base (483)..(483): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagcccccctcccaggtgaaattggtgcagtctggctttgaggtgaggaagcctggggcctctctgaaagtcccctgccaggcttctggatacatcttcaacgtctattacatccactgggtncgccacggcccctggtcaagggcctgagtgggtggctccagtcaaccccaacacgtgcgacacaaactctgcacagactttcagggcagggtccaccagtcggaccccgggacaaccgtccaatcaaatacagcctacataggaactcagtagacgtaaaatcagacgacacggcctctattacgtgtggngagaggcagagttccgagtggggaatacgtgccgnaattgttgtgttgttgtattgttcgttcggaacggaggaacgtagtcgttacgtaaccgttcgtcg

SEQ ID NO: 431599 - DNA, 531 bp, Homo sapiens
  misc_feature: GZ8MTXP01DE3MU.39.73.G07.1.454.CMB.2.raw
  modified_base (255)..(255): a, c, t, g, unknown or other
  modified_base (422)..(422): a, c, t, g, unknown or other
  modified_base (450)..(450): a, c, t, g, unknown or other
  modified_base (458)..(458): a, c, t, g, unknown or other
  modified_base (471)..(471): a, c, t, g, unknown or other
  modified_base (483)..(483): a, c, t, g, unknown or other
  modified_base (485)..(485): a, c, t, g, unknown or other
  modified_base (488)..(488): a, c, t, g, unknown or other
  modified_base (499)..(499): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgtctatacatccatgggtncgccacggccctggtcaagggcctgaggtgggtggctcactccaacccaacacgtggcgacacaaactctgacacagtaacttcgagggcaggtccacgatcgaccggacaacgtccaatacaatacagaccctagactacggaaactcaaggtaagaccgtaaaanctaggaacacgacggcctatattactgnggacgagngcagcgtccgagngggtaatgcgcntntgngtgttgttagnttgcgaggaacagtaacagtcgactcgttctc

SEQ ID NO: 431600 - DNA, 561 bp, Homo sapiens
  misc_feature: GZ8MTXP01DAR1Y.39.73.G07.1.454.CMB.2.raw
  modified_base (308)..(308): a, c, t, g, unknown or other
  modified_base (371)..(371): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtccctgccaggcttctggatacatcttcaacgtctattacatccactgggtgcgccaggccccctggtcaagggcctgagtgggtggctccagtcaaccccaaanactggcgacacaaactctgcacagaacttcaggcaggtccaccatcgacccggacaacgtccntcaaatacagcctacatgaactcagtagacgtaaaatcagacgacaaccggcgttactattaacctggtacggcgaagagggaccaggagttccgacgttaggggataaagtgcgctaatttcgatgttgtttagattacgttcggttaggggaacgaagggaactaaggtcgttacgtaaccgttctcg

SEQ ID NO: 431601 - DNA, 570 bp, Homo sapiens
  misc_feature: GZ8MTXP01D4739.39.73.G07.1.454.CMB.2.raw
  modified_base (258)..(258): a, c, t, g, unknown or other
  modified_base (307)..(307): a, c, t, g, unknown or other
  modified_base (395)..(395): a, c, t, g, unknown or other
  modified_base (401)..(401): a, c, t, g, unknown or other
  modified_base (408)..(408): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagcccccctcccaggtgaaattggtgcagtctggctttgaggtgaggaagcctggggcctctctgaaacgtcccctgccaggcttctggatacatcttcaacgtctattacatccactgggtncgccaggcccctggtcaagggcctgagtgggtggctcatcaaccccaanactggcgacacaaactctgacacagaactttcgagggcaggtcccaccatcggaccccggacaaccgtcaagtcaaatacagccctanatgacncgagtanacgtaaaatcgtagacgacaccggtacgtactattactgtggacgaggaggacagacgtccgacgtagggataagtgcggctaagtttcgatgttctttaggtattagttcgttaggggaaccgtaagggaacgtaagtcggttactaaccgttcgttaacc

SEQ ID NO: 431602 - DNA, 608 bp, Homo sapiens
  misc_feature: GZ8MTXP01CNAXA.39.73.G07.1.454.CMB.2.raw
  modified_base (488)..(488): a, c, t, g, unknown or other
  modified_base (530)..(530): a, c, t, g, unknown or other
  modified_base (550)..(550): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtccctgccaggcttctggatacatcttcaacgtctattacatccactgggtcgcgccacggcccctggtcaagggcctggaggtgggtcggctccactccaaccccaacactggacgacaacaaactctagaccaacacgtacctttcgacggggcagggtcccaccgagtcggaaccccgggacaaaccgtccaactacaaacgtacacgaccctaacagtacggaactacgtaagtaacgacgtaaaactcgtaaggacacgaccgggtctactaattacgngtgggacgtagaggcagtacgtccgagtaggggatagcgccntaagttcgattgcgtttagnttacggcgttacggggaacctaaagggaactaacggtcggttactccggttctaaccg

SEQ ID NO: 431603 - DNA, 666 bp, Homo sapiens
  misc_feature: GZ8MTXP01B7NQQ.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtgcgccacggcccctggtcaagggcctgagtgggtggctcatccaaccccaacacgtgcgacaacaaactctagcacagtaacttcgaggcagggtcccacatcgacccggacaacgtccaatacaaataccacgacctaacagtacggaactacgaagtaagaacgtaaaatcgtacgtaaccgaacgaccggtaccgtacttaagttacgttggtacggggacggaaggacggacgtaaacggtacgttaccccgaaggttacgggggtaacttaaagggtcgacggtccgtaagtttcggttaagtttcgttccgtttttaggaacgtttacgttcgggttacgggggtaaccgtaaacgggggtaactaaacgggttcggttacccgtaacccggtttcgtttccccg

SEQ ID NO: 431604 - DNA, 548 bp, Homo sapiens
  misc_feature: GZ8MTXP01CJKPI.39.73.G07.1.454.CMB.2.raw
  modified_base (254)..(254): a, c, t, g, unknown or other
  modified_base (445)..(445): a, c, t, g, unknown or other
  modified_base (496)..(496): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggagcctggggcctctctgaaagtcccctgccaggcttctggatacatcttcaacgtctattacatccatgggtncgccaggcccctggtcaagggcctggagtgggtggctccagtcaaccccacactgcgacacaaactctgcacagaactttcagggcagggtccaccatgacccgggacaaccgtccaatcaaatactagcctacatcggaactcagtagacgtaaatctagacgacaccggcgtctattactgtggcgagnggcagagtccacgtggggataaggtgcgctaagtttcgattgttcttttgnttagttcgttggggaaccaggggaacaagtgggttactaaccggttcgttcc

SEQ ID NO: 431605 - DNA, 589 bp, Homo sapiens
  misc_feature: GZ8MTXP01BP1DN.39.73.G07.1.454.CMB.2.raw
  modified_base (220)..(220): a, c, t, g, unknown or other
  modified_base (256)..(256): a, c, t, g, unknown or other
  modified_base (285)..(285): a, c, t, g, unknown or other
  modified_base (298)..(298): a, c, t, g, unknown or other
  modified_base (301)..(301): a, c, t, g, unknown or other
  modified_base (311)..(311): a, c, t, g, unknown or other
  modified_base (351)..(351): a, c, t, g, unknown or other
  modified_base (360)..(360): a, c, t, g, unknown or other
  modified_base (379)..(379): a, c, t, g, unknown or other
tcagtcgcactagtcacgaccggtgctcgatttagctctacgctcaggggtttctctagagaaaccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttcnggatacatcttcaacgtctattacatccactgggtncgcaggccctggtcaagggctgagtgggngctcatcacccancgngcgacacaanctgcacagaacttgaggcaggtccaccatcggacccgganaaccgtccntcaaatacacgaccctaanagtacgactacgaagtacgtaacgtaaatcgtacgacgacgtaccggaccttacttaatacgtcggtacgggacgaaggacgacgaacgtaccgtaccgtaggtagggaacgtagtcgacgtcttaagttcgagttacgttcgtttagtagttacgttcggttacgggtaacggtaacggtaacgtacgtacggttacgtccgttcgtcg

SEQ ID NO: 431606 - DNA, 590 bp, Homo sapiens
  misc_feature: GZ8MTXP01CGPHF.39.73.G07.1.454.CMB.2.raw
  modified_base (370)..(370): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggagcctggggctctctgaaagtcccctgccaggcttctggatacatcttcaacgtctattacatccactgggtgcgcaggccctggtcaagggcctggagtgggtggctccatccaaccccaacactcggcgacaacaaactctgcacagaactttcaggcaggtccaccagtcgacccggacaaccgcntcaaatacagcctacatacgaactcagtagacgtaaaatcgtacgacgacgacggacctctaactacgtgttaggacggaagtacggacgagtacgtaccgacggtagggtaataaaggtgcgtacgtaatttcgattcgttcgtttagtagttagttcggttacgggtaacccgtaaggggtaaccaaagttcgggttactaacccggttcttaacccg

SEQ ID NO: 431607 - DNA, 694 bp, Homo sapiens
  misc_feature: GZ8MTXP01EB3GW.39.73.G07.1.454.CMB.2.raw
  modified_base (308)..(308): a, c, t, g, unknown or other
  modified_base (402)..(402): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggagccgtggggcctctctgaaacgtcccctgccaggcttcaggatacatcttcaacgtctattacacccagtgggtgccgccaggcccctggtcgaaggcctggagtaggtggctcatccaaccccanactgacacacaactctgacacagtaactttcgaggcgacggtcacccagtcggacccgggacaccgtaccaatcaaataccgacgtaccctaanacgtacggaaacctacgtaaggtaacgaacgtaaaactcgtaacggaaccggaacgtacccggtaccgttacttaacgttaccgtaggttacggacgggggtaaggaacgggtacgtaacggtacggttacccgaagggttacgggggtaaatacgggttcgaccggtccgttaagtttaaccgggtaatttcggttactttttaggaacgtttaggttccggttacgggggacccgtaaaggggtactaaggttccggggtaccttacccggtttccgttcccgttaaccg

SEQ ID NO: 431608 - DNA, 752 bp, Homo sapiens
  misc_feature: GZ8MTXP01BDYJY.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctcccaggtgaaattggtgcagtctggctttgaggtgaggaagccgtggggcctctctgaaacgtcccctgccaggcttctggatacatcttacaacgtctattacatccacgtgggtcgccgccgacggccccgtggtacgaacgggcctggaggtcggggtcgggcctaccacgtacccaaacccccaacgaccgtcggaccgaacaaccgaaacctctaggacccaacgtaacgtaaacctttcggaacggggtccgaacgggtcccccaaaccgtacggtacccggggaaacccccgggtaccgaaacccggttacccaacttaacccaaacttacccgaccggtaccccttaacgacgttaacgggaaccttaccgaaaggtaacgaaacgttaaaacgtcgtaacggaccgtaccgaccgggtacccttacttaagttacgtggtacgggacggtaacggacggcgaacgttaacgttcccggaaggttagggggaataacgggtcgtacggtcttaagtttaccgttagttcgtttgtttgtagttacgttcgggacggggtaacgaaacggtaactacggtcggttaccgtccgttctcccg

SEQ ID NO: 431609 - DNA, 587 bp, Homo sapiens
  misc_feature: GZ8MTXP01CQ3T8.39.73.G07.1.454.CMB.2.raw
  modified_base (294)..(294): a, c, t, g, unknown or other
  modified_base (312)..(312): a, c, t, g, unknown or other
  modified_base (415)..(415): a, c, t, g, unknown or other
  modified_base (441)..(441): a, c, t, g, unknown or other
  modified_base (521)..(521): a, c, t, g, unknown or other
  modified_base (525)..(525): a, c, t, g, unknown or other
  modified_base (539)..(539): a, c, t, g, unknown or other
  modified_base (546)..(546): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggaagccgtggggcctctctgaaacgtcccctgccaggcttctggatacatcttcaacgttctattacatccacgtgggtcgcgccaggcccctggtcaagggcctggagtgggnggctcagtccaacccaanactggacgacacaaactctgacctaacgaacgtaactttcgaagggcgaacgggtccccaaccgagtcggaaccccggggacaacccgttaccaataccaaanaccacgacctaacagtacggaacctnaagtagacgtaaaatcgtagacgacacggacctatacttactgtcgggagagacgcgagtacgtccaggtagggatagtncgtntaagttcgatgttntttagtnttagttcggacggaacgaagtcgtagtcgactcgttcgtcg

SEQ ID NO: 431610 - DNA, 341 bp, Homo sapiens
  misc_feature: GZ8MTXP01CIN3B.39.73.G07.1.454.CMB.2.raw
  modified_base (248)..(248): a, c, t, g, unknown or other
  modified_base (260)..(260): a, c, t, g, unknown or other
  modified_base (265)..(265): a, c, t, g, unknown or other
  modified_base (273)..(273): a, c, t, g, unknown or other
  modified_base (336)..(341): a, c, t, g, unknown or other
tcagtcgcactagtcacgaccggtgctcgatttagctctacgctcagggtcaccatgacccgggacacgtccatcaatacagcctacatggaactcagtagcgtaaaatctgacgacacggccgtctattactgtgcgagaggcagagttccactggggataagtgcgcatttcgatgcttttgatatctggggccaagggacaatggtcaccgtctcttcagcctccacaggcccatcggtctcccngcacctctcagncactntgggcacngcgcctggctgctgcaggactacttcactagtgcgactgagcgggctcggcaggcgcataagnnnnnn

SEQ ID NO: 431611 - DNA, 655 bp, Homo sapiens
  misc_feature: GZ8MTXP01C483L.39.73.G07.1.454.CMB.2.raw
  modified_base (258)..(258): a, c, t, g, unknown or other
  modified_base (565)..(565): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtccctgccaggcttctggatacatcttcaacgtctattacatccacgtgggtcncgccacggcccctggtcaagggcctggagtgggtcggctccatccaaccccaacacgtggcgacaacaactctgcacagtactttcgacggcgacggtccaccgatcggacccggacaaccgtccaagtacaaactaccacgacctaacagtacggaactacgaagtaagaacgtaaaatcgtacgaacgacgtaccgggtaccttactaacgtttacgtaggttacgggacgaaggacggacgtaacgtaccgttacccgaacggtagggggtaattaaacggtggcgtaccgtaagtttaaccgngtttacgttccgttttaggaattacgttcggttacggggaacgtaaacgggaacgttaacgtcggttaccgtaacccgttctttaacccg

SEQ ID NO: 431612 - DNA, 653 bp, Homo sapiens
  misc_feature: GZ8MTXP01CZ32S.39.73.G07.1.454.CMB.2.raw
  modified_base (255)..(255): a, c, t, g, unknown or other
  modified_base (305)..(305): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaacgtccctgccaggcttctggatacatcttcaacgtctattacatccactgggtncgccacggcccctggtcaaggctgaggtgggtggctcgactcaccccaanactaggcgacacaaactctacgcacagtaactttcgagggcacgggtcccaccagtcgaacccgggacaaccgtaccaatacgaactaacacgacctaacagtacggaacttcgaagtagacgtaaaatcgtaacgacgacgacggaccgttactaagttaccgtgttaggaccggaaggacggaccgtaacgtaaccggttaccccgaacggttaacgggggtaattaaacggttcggaccgtacgttaacgtttacgaagtttggttacctttttagattcggttcggttccggggaaccgtaaaggggtcctaaggtccggttacgtaacccggttcttaacccg

SEQ ID NO: 431613 - DNA, 657 bp, Homo sapiens
  misc_feature: GZ8MTXP01D3QN1.39.73.G07.1.454.CMB.2.raw
  modified_base (257)..(257): a, c, t, g, unknown or other
  modified_base (388)..(388): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtcncgccacggcccctggtcaagggcctggaggtgggtgggctccactaccaaccccaacacgtggacgacaacaaactctgcaacagtaactttgagggacaggtcccaccagtcgacccggacaaccgtacntacaatacacgcctaacatacggaactcgtaagtagacgtaaaatctaacgaccgaacaccgggtacctacgtaattacgtggttacgggacgtaggacggacgtacgtacggttaccgaacggtaggggtaacgttaaggtcggtacgtacgtaacgtttcggagttgttaccgttttaggtacgttaaacggttccggttacgggggaaccctaaagggggtaacccttaaagggtccggttaccgtaacccggtttaacctttccg

SEQ ID NO: 431614 - DNA, 636 bp, Homo sapiens
  misc_feature: GZ8MTXP01DJ3A2.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggaagccgtggggcctctctgaaacgtccctgccaggcttctggatacattcttcaacgtctattacatccagtgggtcgcgccacggcccctggtacaagggcctgaggtgggtggctccatcaaccccaacactggcgacacaaactctgcacagactttcgagggcacgggtccaccagtcggaccccgggacaaccgtaccaatacaaactacacgacctacagtacggaactcaagtacgaacgtaaatcgtacgacgtacaccggtccgtactaacttacgtcggtacggacggaggaaggacgaaggtacgttaccgtacggtaggggtaagtaaggtcgcggtactaacgttttcgttaagttcgttcgttttaggagttacgttcggttacggggaacccgtaaaagggggcctaaaggtcgggttacctaaccggttcctttaaccg

SEQ ID NO: 431615 - DNA, 681 bp, Homo sapiens
  misc_feature: GZ8MTXP01CKOXE.39.73.G07.1.454.CMB.2.raw
  modified_base (291)..(291): a, c, t, g, unknown or other
  modified_base (319)..(319): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgcccccctcccaggtgaaattggtgcagtctggctttgaggtgaggaagccgtggggcctctctgaaacgtcccctgccaggcttctggatacatcttacaacgttctattacatccagtgggtgccgccacggcccctggtcaagggcctggnggtgggtggctccgactccaaccccaancgtggaccgacaaccaaactcagacaacgagtaactttcgaagggcgacgggtacccaccagtcgaaccccgggacaaccgtaccaactacaaactaccgacgacctaacaacgtacggaaacctacgaaggtaacgtaacggttaaaatccgtaacgaccgacgaccgtccgttacttacgttacgtgtacgggaggtacggaacggaccgtaaggtaccgttacccggtacggtagggggtaactaaagggttcgtaccggtctaacgttttccgaagtttcggttacttttaggacttacgttcggacggggtaaccgaaaggggtaactaggtcggttacctaaccgttccgtaaccg

SEQ ID NO: 431616 - DNA, 565 bp, Homo sapiens
  misc_feature: GZ8MTXP01DMBZM.39.73.G07.1.454.CMB.2.raw
  modified_base (195)..(195): a, c, t, g, unknown or other
  modified_base (255)..(255): a, c, t, g, unknown or other
  modified_base (385)..(385): a, c, t, g, unknown or other
  modified_base (414)..(414): a, c, t, g, unknown or other
  modified_base (430)..(430): a, c, t, g, unknown or other
  modified_base (458)..(458): a, c, t, g, unknown or other
  modified_base (493)..(493): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctntctgaaagtcccctgccaggcttctggatacatcttcaacgtctattacatccatgggtncgccacggcccctggtcaagggcctggagtcggggtcggcgtccaaggtaccgaacccccaaagtacgtcggacacaacaaactctgacaacgagtaacttcgaggcagggtcccaccatcgacccgganaaccgtccaatccaaatacacgcctacanagactgagtagacaanatagacgacacgacgtctatactgtggngagagagacgtagtccgacgaggagtaagtgcggnaattggttattgttcgttagtattagttcggttcggaacggtaggaacgtacgtacgttcgtccgttcgtcg

SEQ ID NO: 431617 - DNA, 647 bp, Homo sapiens
  misc_feature: GZ8MTXP01DK8YP.39.73.G07.1.454.CMB.2.raw
  modified_base (540)..(540): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctccaggtgaaattggtgcagtctggctttgaggtgaggaagcctggggcctctctgaaacgtcccctgccaggcttctggatacatcttacaacgtctattacatccatgggtgcgccacggcccctggtcaagggcctggagtgggtggctccatccaaccccaacacgtcggacgacacaaactctgcaacacgtaactttcgaagggacacgggtcccaccgagtccggaacccggggacaaaccggtcccaatacaaataccagaccctaacgatacggaaacttcgaagtaagacgttaaaactcgtacgaaccgaacaccggtccgtacttaactacgtgtggacgaagacggacagtacgtacgacgtagggggtaataaggtcgccggtntaattttcggatttacgttgtttttacggaacttaagttccggttacgggggaacccaaaggggtaaccgtaaggttacgggttaccttaaccccggtttcgttccg

SEQ ID NO: 431618 - DNA, 669 bp, Homo sapiens
  misc_feature: GZ8MTXP01EHAQH.39.73.G07.1.454.CMB.2.raw
  modified_base (256)..(256): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgtctattacatccatgggtncgcaggccctggtcaaggctgagtgggtggctcatcaaccccaacactggcgacaacaaactctgcacagaactttcgaggcacggtccaccatcgacccggacaacgtcaatcaatacagacctacagtaggaactacgaagtagacgtaaaatctagaccgtaacgaccgggtaccgtactaacttaacgtcggttacgggaccggtaaggaacgggaccgtaaaggtaccggtttacccgtaacggttacgggggtaaattaaagggtacggtaccggtacgttaacgttttccttaacgttcgtttaccgtttttagtaacgtttacgttcgggttacgggggtaaccggtaaacggggtaaccgtaaaggtacgggttacccgtaaccccgtttccggtttaaccccg

SEQ ID NO: 431619 - DNA, 689 bp, Homo sapiens
  misc_feature: GZ8MTXP01BW5GY.39.73.G07.1.454.CMB.2.raw
  modified_base (259)..(259): a, c, t, g, unknown or other
  modified_base (311)..(311): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttacaacgtctattacactccatggggtnccgccacggcccctggtcaagggcctgaggtgggtggctcatccaaccccanactcggcgacacaaactctagacacagtaacttcgaggcagggtcccaccgagtcggacccggacaaccgtccaagtacaaactacacgacctaacgagtacggaactagaacggtaacgacgtaaaactcgtaaggaccgtaaccgaccggtaccgttacttaacttaccgtaggttcggggaccggtaagggaacggtacgtaaggtaaccggttacccgaacgggttaacgggggtaagttaaacgggtcggtacggtacgttaacgtttacgttagttcgttacgttttagaactttacggttcgggttacgggggaacccgtaagggggtaactaaacggtccgggttaccttaacccggttcgtttaacccg

SEQ ID NO: 431620 - DNA, 583 bp, Homo sapiens
  misc_feature: GZ8MTXP01EPFGL.39.73.G07.1.454.CMB.2.raw
  modified_base (289)..(289): a, c, t, g, unknown or other
  modified_base (306)..(306): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagccgtggggcctctctgaaagtcccctgccaggcttctggatacatcttcaacgtctattacatccactgggtgcgccaggcccctggtcaagggcctgagtgggnggctccatcaaccccanactggcgacacaaactctgcacagaactttcgaggcagggtcccaccatcgacccgggacaaccgtccaatcaaataccacgcctacatagaactcaagtagacgtaaatcgtacgacgacgacggaccgtctacttacgtgtaggttgaggtaggacgagtacgttccgtacgtaggggtataaggtgccggctaagtttcgttatgttcgttttagacttagttcgttggggaacctaaggggaacctaagtcggttacctcccggttcttcccg

SEQ ID NO: 431621 - DNA, 578 bp, Homo sapiens
  misc_feature: GZ8MTXP01ECU32.39.73.G07.1.454.CMB.2.raw
  modified_base (256)..(256): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggtgggctccgatcaaccccaacactggcgacaacaaactctgacacagaactttcaggcagggtcaccatcgacccggacaaacgtccaatcaaatacagcctaacatagaactcaagtacgacgtaaaatgtagacgaacaccggaccgtctaattactgtgtcggagaggacagacgtccgacgtaggggagtaaagtgtcgcgtaagtttcgatggttctttaggattaagttcgttaggggcccgaaaggggtaactaaagtcggttacgtaacccgttcgtttcccg

SEQ ID NO: 431622 - DNA, 715 bp, Homo sapiens
  misc_feature: GZ8MTXP01AWD6H.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggacgcccccctcccaggtgaaattggtgcagtctggctttgaggtgaggaagccgtggggcctctctgaaacgtcccctgccaggcttcgtggatacatcttacaacgtctatacatccacgtgggtcgccgccacggcccctggtcgaagggcctggaggtgggtcgggcctccgactccaaaccccctaacaccgtcggaccgaaccaccaaaacctctagaccaacgaacgtaactttcgaggggccagggtccccaccgagtcggaaccccggacaacccgttaccaataccaaactacacgacctaacagtacggaactacgaagttacgaacgttaaaactcgtacgaaccgaccgaccgggtaccgtacttaacgttaccgtagtcggggacgaacggggacggaccgaaggttacgttcccgaaggttacgggggtaaattaagggtcgacgtaccgttaagtttccggttaattcggttacgttttaggtactttacggttcgggttacgggggaaaccctaagggggtaacctaacggttcccggttacgtaacccggtttcgttaacccg

SEQ ID NO: 431623 - DNA, 732 bp, Homo sapiens
  misc_feature: GZ8MTXP01D1L4K.39.73.G07.1.454.CMB.2.raw
  modified_base (282)..(282): a, c, t, g, unknown or other
  modified_base (290)..(290): a, c, t, g, unknown or other
  modified_base (309)..(309): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgcccccctccaggtgaaattggtgcagtctggctttgaggtgaggaagccgtggggcctctctgaaacgtcccctgccaggcttctggatacatcttacaacgtctattacatccactgggtgcgccaggcccctggcaaggccngagtgggnggctcactcgaaccccaanacgtgacgacaacaaactctgacaacagtaactttcgaggcgacggtccaccatcggacccgggacaaccgtcaatacaaactacacgaccctaacagttacggaactacgtaagtaaggaaccgttaaaaatccgttaacggaacgtaaccgacccggggtaacccgttacgttaaacttaaccgttaggttacggggacccggtaaagggaacgggtaacccgaaaggtaacggtttaaccccggaaacggtttacggggggtaaacttaaagggttcggacccgttacggtaaattttccgggttaactttacggttacgttttaagtaacgttagtttccgggttacgggggtaaccccgtaaaaggggaacccgtaaaagggttcggttacccgtaaacccggtttccgtttaacccg

SEQ ID NO: 431624 - DNA, 660 bp, Homo sapiens
  misc_feature: GZ8MTXP01EIVP7.39.73.G07.1.454.CMB.2.raw
  modified_base (396)..(396): a, c, t, g, unknown or other
  modified_base (430)..(430): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctcccaggtgaaattggtgcagtctggctttgaggtgaggaagccgtggggcctctctgaaacgtcccctgccaggcttctggatacatcttcaacgtctaattacactcctactggggtcgccgccacggcccctggtcaagggcctggaggtcgggtcggctccgaacgtcccaaccccaacgacgtcggaccgacaacaaactcagacacagtacttcgaggcaggccaccagtcgacccgacaacgaccngtaccaaatacacgtaccactagacgtaacctanaagtacgaacgtaaaactcgtaacggaacaaccgaccggtaccgttacttaattacgtcggtaggacggaagtaccggacgaagtacggttacccgagggttaggggaaactaaggtacgccgtacttaacgttttacgagtttggtttactttagtagttaacgttcggttacgggtaaccggtaacgggaacgtaagttacggttccggtaacccgttccgtttcccg

SEQ ID NO: 431625 - DNA, 664 bp, Homo sapiens
  misc_feature: GZ8MTXP01DPCOH.39.73.G07.1.454.CMB.2.raw
  modified_base (256)..(256): a, c, t, g, unknown or other
  modified_base (289)..(289): a, c, t, g, unknown or other
  modified_base (306)..(306): a, c, t, g, unknown or other
  modified_base (402)..(402): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtccctgccaggcttctggatacatcttcaacgtctattacatccactgggtncgcacggcccctggtcaagggcctggagtgggnggctccatcaacccaanactgcgacaacaaactctgccaacagtaactttcgagggcacggtcccaccgatcggacccgggacaaccgtcaatacaaactacacgaccctaanagtacgaactacgaagtaacgaacgtaaactcgtaacgaaccgaacgtaccggtaccgttacttaacttacgtggtacggggaacggaacggaacggacgtaacggtaccgttacggtaacgggttaaggggtaattaacgggtacgtacgttattaacgttacgttagttcgttacgtttagttagttacgttcgggttacggggtaaccgggtaaacgggtaacggtaacggtacggttaccgtaacccgttccgttccg

SEQ ID NO: 431626 - DNA, 723 bp, Homo sapiens
  misc_feature: GZ8MTXP01D7F4V.39.73.G07.1.454.CMB.2.raw
  modified_base (312)..(312): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacattcttcaacgtctattacactccacgtgggtgcgccaggcccctggtacaagggcctgaggtgggtggctccatccaaccccaanactcggcgaacacaaactctgcacagtaactttcgaggcacggtccaccgatcgacccggacaaccgtccaattacaaactacacgacccttaacgacgttacgggaaccttacgaacgttaacggaaccgttaaaaacgtccgttaacggaaaccgaacccgtaaccggggttcccttaaccgttaagtttaacccgtggttaacggggcccggtaaaggacggggactaacggtacggtttaccccgtaacgggttagggggtaaacttaaagggtcgtaccgggtccttaagttttcgttagttgggtttacctttttaggaagtttacgttcgggttacgggggtaacccgaaaagggggtaacctaaacggttcgggttaacccgttccggtttaaccgtttcccg

SEQ ID NO: 431627 - DNA, 605 bp, Homo sapiens
  misc_feature: GZ8MTXP01C0OY2.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctccaggtgaaattggtgcagtctggctttgaggtgaggaagccgtggggcctctctgaaacgtcccctgccaggtcttctggatacatcttacaacgttctattacatccactgggtgcgccaggcccctggtcaagggcctggaggtgggtggctccatccaaccccaacactggacgacacaaactctgacacagtaactttcgacggcagggtcccaccgatcggacccggacaaccgtccaatacaaatacacgacctaacatacggaactacaaggtagaacgtaaaatcgtacgacgacgaccggccgttactaattactgtgggacgtaggacgcaagtacgtaccacggtaggggaataaggtcgcgtacttaagttcgagttcgttacttttaggacttagttcggttacggggaacaaggggtaactaaggtcgttactaaccgttctaaccg

SEQ ID NO: 431628 - DNA, 578 bp, Homo sapiens
  misc_feature: GZ8MTXP01C6NBA.39.73.G07.1.454.CMB.2.raw
  modified_base (286)..(286): a, c, t, g, unknown or other
  modified_base (316)..(316): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtccctgccaggcttctggatacatcttcaacgtctattacatccactggggtgcgccaggcccctggtcagggcctgagtggnggctcatcaacccacactgcacacaactcngcacagactttcgaggcaggtccaccatgacccgggacaaccgtcaagtacaaagtacacgcctaacagtacggaactcaagtagacgtaaaatctaagacgaacgacggccgtactattacgtgtagggacgagacggcaaggacgttcccgaggtacggggtaataacggtggacgtctaagtttcgaattggttacttttagattacgttcgttacggggaaccaaggggtctaagtcggttcctaaccgttctttccg

SEQ ID NO: 431629 - DNA, 615 bp, Homo sapiens
  misc_feature: GZ8MTXP01A34K0.39.73.G07.1.454.CMB.2.raw
  modified_base (254)..(254): a, c, t, g, unknown or other
  modified_base (309)..(309): a, c, t, g, unknown or other
  modified_base (329)..(329): a, c, t, g, unknown or other
  modified_base (357)..(357): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctccaggtgaaattggtgcagtctggctttgaggtgaggagcctggggcctctctgaaagtcccctgccaggcttctggatacatcttcaacgtctattacatccactgggtncgccacggcccctggtcaagggcctggagtgggtgcgtcagtcaaccccatacgngcgacacaactctagaccanacgtaacttcgaggctaggcccaccgancggaacccggcaaccgtcaatacaaactacgactacctatactacggaactcgaagtaacgacgttaaaacgtcgtacgaaccgtacgtaccggtccgtacgttacttacgcgtacgggacggaaggacgacgacgtacgtaccgaggtagggtaatacggtcgtcgtactaactttcggattcgttagttacgtacgttacgttcggttacggaacggtaacgggtaacgtaacgtacgttacgtaaccgttcgtcg

SEQ ID NO: 431630 - DNA, 704 bp, Homo sapiens
  misc_feature: GZ8MTXP01AY9LT.39.73.G07.1.454.CMB.2.raw
  modified_base (262)..(262): a, c, t, g, unknown or other
  modified_base (610)..(610): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggagccgtgggcctctctgaaacgtcccctgccaggtcttctggatacattcttacaacgttctattacatccacgtgggtcncgccacggcccctggtacaacgggcctggaggtgggcggcctaccacgtacccaaaccccaacacgtacggaccgaaccaaccgaaactcgtacgaccaacgtaacgtaaccgtttcggaacggggtacgaacggggtaccccaacccggagtacccgggaaccccggggtacctaacccgttacccaacgttaaccaaaacgtaccgacggtaaccctaacgacgtaacgggtaactacggtaagtaacgtaacgtaaatcgtaacgacgacgaccggtcttactattacgtgtaggacgaggacgacgagtacgttaccgaggtaggggataaggtcgcgtacgtntttacggagttcggttactttagtagttcggttcgggttacggggtaaccgtaagggtaacctaaggttcggttacctaacgttccgttaaccg

SEQ ID NO: 431631 - DNA, 251 bp, Homo sapiens
  misc_feature: GZ8MTXP01C98BJ.39.73.G07.1.454.CMB.2.raw
  modified_base (248)..(251): a, c, t, g, unknown or other
tcagtcgcactagtcacgaccggtgctcgatttagctctacgctcagggtcttcgtggctcacgtccaccaccacgcatgtgacctcaggggtccgggagatcatgagggtgtccttgggtttggggggaagaggaagactgacggtcccccaggagttcaggtgctgggcacagcggccctgggctgcctggtcaaggactacttccactagtgcgactggaggcgggcgtggcaaggcgacatagnnnn

SEQ ID NO: 431632 - DNA, 659 bp, Homo sapiens
  misc_feature: GZ8MTXP01AZ8T6.39.73.G07.1.454.CMB.2.raw
  modified_base (258)..(258): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagcccccctcccaggtgaaattggtgcagtctggctttgaggtgaggaagccgtggggcctctctgaaacgtcccctgccaggcttctggatacatcttcaacgtctattacatccatgggtnccgccacggcccctggtcaagggcctggaggtgggtgggcctccactccaaccccaacacgtcggaccgaacaaccaaactctacgacaacgacgtaacctttcggaaggggtaccgacggggtacccccaaccgtacgtaccggaaccccgggaacaaacccgttacccaataccaaacgtacccacgacccttaacgagttacggaactacgaaggtaacgtaacgtaaaactcgtacgaaccgacgaccggcgttactaattacgtgtgggacgtaggacgtacgagtacgtccgacggtagggtataacgtcgcgatcgttcgattacgttcgtttagacttagttcggttcgggaaccgagggtaactaagtcgttaccgtaacgttcgttaaccg

SEQ ID NO: 431633 - DNA, 670 bp, Homo sapiens
  misc_feature: GZ8MTXP01DPUEP.39.73.G07.1.454.CMB.2.raw
  modified_base (236)..(236): a, c, t, g, unknown or other
  modified_base (254)..(254): a, c, t, g, unknown or other
  modified_base (283)..(283): a, c, t, g, unknown or other
  modified_base (298)..(298): a, c, t, g, unknown or other
  modified_base (390)..(390): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctccaggtgaaattggtgcagtctggctttgaggtgaggagcctggggcctctctagaacgtccctgccaggcttctggatacatcttcaacgtntattacatccactgggtncgcacggccctggtcagggcctgagtggngctcagtcaacccanctgcacacaaactctagacaacgagtactttacgaggcgaggtcccacagtcgacccggacaaccgtcaactacaaacgtacacgaccctanacgtacggaacttacgaagttacgaaccgttaaaatcgttaacggaaccgacgtaccgggtaccttacgtaattaaccgttggtcgggaccggtaaggacggtaccgaggtaacgttacccgaagggttacgggggtaactaaaggtcgggtaacggtaaagttttcggtaaaggttttgggtttttacggaaagttggggtacgttacgggggacccgttaaaggggaacctaaaggttccgggtaccctacggttaccgttcctttccggtaaccccg

SEQ ID NO: 431634 - DNA, 623 bp, Homo sapiens
  misc_feature: GZ8MTXP01EF8VR.39.73.G07.1.454.CMB.2.raw
  modified_base (257)..(257): a, c, t, g, unknown or other
  modified_base (544)..(544): a, c, t, g, unknown or other
  modified_base (558)..(558): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctcccaggtgaaattggtgcagtctggctttgaggtgaggaagccgtggggcctctctgaaacgtcccctgccaggcttctggatacatcttcaacgtctatacatccatgggtncgccgacggcccctggtacaagggcctggagtcgggtcggcgtccacgtccaacccaacacgtggacacacaaacgtctagacaacgagtaacttcgacggacacgggtaccccacgaacgtcgaccccggacgaaccgtaccaataccaaataccacgtacccaactagtacggaacccttagaagttacgaacgtaaaactcgtaacgaacgaccgaccggacccttagtacttaacgttgacggggacgaggacgacgtagtaccgtccaggtagggactaggngcgtatgttcgttnttgttgttagtattcgttcggttacgggaacgaagtaactacggtcgttaccgtccttgttcccg

SEQ ID NO: 431635 - DNA, 684 bp, Homo sapiens
  misc_feature: GZ8MTXP01CYWXE.39.73.G07.1.454.CMB.2.raw
  modified_base (315)..(315): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggagccgtggggcctctctgaacgtccctgccaggcttctggatacatcttacaacgttctattacatccacgtgggtgcgccgacggccctggtcgaagggcctggaggtgggtggctccactaccaaccccaanacgtcgacgacacaaactctacgacacacgtacttacgacggcgacggtacccaccgagtccggacccggacaacccgtacaagtacaaactaccacgtacctaacaagtacggaacttacgaaaggttaacgaacgttaaaactccgtaacggtaccgtaaccgtaaccgggtaccttacgttacgttaacgtcggtagggaccggaaggacgcgtaaggtaccgttacccggtaggttagggggaattaacgggtcgaccggttattaacgtttacggatttcgggttactttttagggactttacggttcgggttacggggaactaaacggggtctaacggttcgaccttaaccggttcttaaccg

SEQ ID NO: 431636 - DNA, 671 bp, Homo sapiens
  misc_feature: GZ8MTXP01BO6OY.39.73.G07.1.454.CMB.2.raw
  modified_base (260)..(260): a, c, t, g, unknown or other
  modified_base (321)..(321): a, c, t, g, unknown or other
  modified_base (455)..(455): a, c, t, g, unknown or other
  modified_base (580)..(580): a, c, t, g, unknown or other
  modified_base (603)..(603): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctccaggtgaaattggtgcagtctggctttgaggtgaggagccgtggggcctctctgaaagtcccctgccaggcttctggatacattcttacaacgttctattacatccactggggtcncgccgacggcccctggtcaagggcctggaggtggggtcggactccacgtaccaaccccaanaccgtggaccgaacaaccaaacttcgacgaccaactacgtaaacctttcggaacgggcacggggttaccccaaccgacgtcccggaaccccggggtaacaaccgtcccaataccaaataccacgtccccttaanacgtacggaactacgaagtacgaacgttaaaatcgaaggacccgaacgtaccgggtaccttacttactttaacgtcgtacgggacggaggacgactagtcgttacccgagtaggggattaacggngtacgctaatttcggatcggttntttaacgagttacgttcgggacgggtaaaccgagggtaactaacgtggaccgtaacccttgttaaccc

SEQ ID NO: 431637 - DNA, 595 bp, Homo sapiens
  misc_feature: GZ8MTXP01DKKPO.39.73.G07.1.454.CMB.2.raw
  modified_base (260)..(260): a, c, t, g, unknown or other
  modified_base (308)..(308): a, c, t, g, unknown or other
  modified_base (369)..(369): a, c, t, g, unknown or other
  modified_base (394)..(394): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgcccccctcccaggtgaaattggtgcagtctggctttgaggtgaggaagccgtggggcctctctgaaacgtcccctgccaggcttctggatacatcttcaacgtctattacatccactgggtncgccaggcccctggtcagggcctgagtgggtggctccatcaaccccanactggcacacaaactctgacacagtaactttcgaggcagggtcccaccagtcgacccgganaaccgtcaatacaatacagacctanagtcgaactcgagtagaactaaatctagaaccgacgaccggccgttactacttacgtgtcggacgaaggacggacgagtacgttccgacggtaggggtaactaaggtcgcgtactaagtttcgagttcgttacgttttgattacgttcggttcggggaaccgaaagggctaaacggtcggttacctaaccgttctttaacg

SEQ ID NO: 431638 - DNA, 643 bp, Homo sapiens
  misc_feature: GZ8MTXP01DBEG0.39.73.G07.1.454.CMB.2.raw
  modified_base (412)..(412): a, c, t, g, unknown or other
  modified_base (539)..(539): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggaagcctggggcctctctgaaacgtccctgccaggcttctggatacatcttacaacgtctattacatccactgggtgcgccacggcccctggtacaacggggcctggaggtggggtgggctccactccgaaccccaaacactcggcgaacacaaactctagccaacagaactttcgaagggcacgggtcccaccagtcgacccggacaacgtccaatcaaatacagccctanatacgaactcaaggtagacgtaaaattcgagaaccgtaacgaccgggtaccgttacttaagttaacgttcggtacggggaccgaagggacgaccgtaagtacgttccgacgtaggggtaataaggtnaccgcgtaaagtttcgaagttccggttattttaccgagttacgttcggttacgggggaacaaaagggggtaacaacgttcggttacctaaccgttctttaaccg

SEQ ID NO: 431639 - DNA, 781 bp, Homo sapiens
  misc_feature: GZ8MTXP01EVKKQ.39.73.G07.1.454.CMB.2.raw
  modified_base (220)..(220): a, c, t, g, unknown or other
  modified_base (658)..(658): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggaagcgtggggcctctctagaacgtccctgccaggcttcnggatacattcttacaacgtctattacatccacgtgggtcgcgccgacggccccgtaggtacgaacgggcctggaggtggggtgggcctaccgatacccaaaccccaacaccgtcggaccgtacaaccaaactcgtacgaccacgaagtaactttcgaacggggtcacggggtaccccaaccgagtaccgggaaccccggaacctaacccgtacccaagtacctaaactaaccgacgtaccctaacgtacgtaacgggtaaacctaccggtaagtaaacggtaaacggttaaaacttacgtaacgggtaaaccgaccgtaccgggtacccgttacgttaacgtttacgtacgggttacgggaaccgggaacggtaaccgggacgtaacggtaccgttacccggtaacggtagggggtaaactaacgggtcgtaccggtnttaacgttttaccggagtttacggttaccgttttaggtaacggtttaacggttcgggttacgggggtaacccgtaaagggtaaccgttaaggtccggttacctaacccgttccgtttaacccg

SEQ ID NO: 431640 - DNA, 737 bp, Homo sapiens
  misc_feature: GZ8MTXP01AILHI.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggacgcccccctccaggtgaaattggtgcagtctggctttgaggtgaggagccgtgggcctctcgtagaacgtcccctgccaggtcttcgtaggatactattcttacaacgtctatacatccacgtgggtcgccgccgacggccctggtacaagggcctggtaggtaggggtcggcctccactacccaaccccaacacgtacggaccgacacaaactcgagacacgaagtacgttcgacggtacgtacggtcccaccgagtaccggacccggtactaaccgtacaatacaaataccacgtacctaagacgtaacggactacgagtaacgaacgtaaaacgtcgtaacggaaccgtaaccgtaccggaccgtttacgttaaaccgtttacgtaccgggttacggggaacgggaacggtaaccgggacgttaaacggtaccgtttacccggaaggggttaacggggttaaactaacggggtaccgtaccggtaccgttaaggttttacgaacggttttccgttacggttttagtaacgttcgggttaaccggttacggggtaaccgtaaggtaacgtacggtacggttctaaccggttcgtaaccg

SEQ ID NO: 431641 - DNA, 604 bp, Homo sapiens
  misc_feature: GZ8MTXP01EXGS0.39.73.G07.1.454.CMB.2.raw
  modified_base (258)..(258): a, c, t, g, unknown or other
  modified_base (312)..(312): a, c, t, g, unknown or other
  modified_base (516)..(516): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctcccaggtgaaattggtgcagtctggctttgaggtgaggaagccgtggggcctctctgaaacgtcccctgccaggcttctggatacatcttcaacgtctatacatccactgggtnccgccacggcccctggtcaagggcctggaggtgggcggctccatccaaccccanactggacacacaaactctagccaacgagtactttacgagggacacggtccacgatcggacccggacaaccgtccaatacaaatacacgtacctacgagtacgaactacgagtaacgagtaaaactctacgaccgtacaccggtctctattactgtacggacgtagacggtacagtacgtacccgtaggagggtaacgttaaggngtaccgtcgtaagtttcgttagtcgtttgttatacgttagttcgttcgggtaaccgaggaactagtacgttctaaccgttcgtaaccg

SEQ ID NO: 431642 - DNA, 750 bp, Homo sapiens
  misc_feature: GZ8MTXP01BJJUQ.39.73.G07.1.454.CMB.2.raw
  modified_base (487)..(487): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctcccaggtgaaattggtgcagtctggctttgaggtgaggagccgtggggcctctctgaaacgtcccctgccaggcttcgtggatacattcttacaacgtctattacatccacgtgggtcgcgccgacggccccgtggtcgaagggcctggaggtgggtcgggcctccactacccaaacccccgaaacaccgtcggaccgaaccaacctaaaacctcgtacgacccaacgtaacgtaaccgttttaccgaaggggtccgacggggttaccccaacccggtagtaccgggaacccccggggtaccaacccggttacccaacgtacaaactaccgacgtaccctaanagtacggaacctacgaaggtaacgacgttaaaactcgtaacgaccgtaacgacccggtactacgttaacttacgtggttacgggacggtaaggacggacgtaacgtacgttccggtaacggtacggggtaagttaacggtcggtacgtacgttaacgtttaccggttagttcgttcgttttacgtaagttacggttcgggttacggggaaccggtaaacggggtaacttaacggttcggttacccgtaaccggttcccttccg

SEQ ID NO: 431643 - DNA, 546 bp, Homo sapiens
  misc_feature: GZ8MTXP01CUP8C.39.73.G07.1.454.CMB.2.raw
  modified_base (361)..(361): a, c, t, g, unknown or other
  modified_base (386)..(386): a, c, t, g, unknown or other
  modified_base (425)..(425): a, c, t, g, unknown or other
  modified_base (446)..(446): a, c, t, g, unknown or other
  modified_base (463)..(463): a, c, t, g, unknown or other
  modified_base (469)..(469): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggagcctggggcctctctgaaagtccctgccaggcttctggatacatcttcaacgtctattacatccatgggtgcgccaggcccctggtcaagggcctgagtgggtggctccatcaaccccaacactggcgacacaaactctgcacagaactttcaggcagggtccaccatcgacccggganaaccgtccaatcaaatacagcctanactgaactcagtacgcgtaaatctagacgacacggcctntactactgtgacgagagcagngttcacgtgggactagngcgctnttcgattcgttcttttggattagttcgttacggggtccaaagggggtccaagtcggttactaaccgttcttaacccg

SEQ ID NO: 431644 - DNA, 658 bp, Homo sapiens
  misc_feature: GZ8MTXP01EA3DP.39.73.G07.1.454.CMB.2.raw
  modified_base (240)..(240): a, c, t, g, unknown or other
  modified_base (257)..(257): a, c, t, g, unknown or other
  modified_base (280)..(280): a, c, t, g, unknown or other
  modified_base (452)..(452): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagccgtggggcctctctgaaacgtcccctgccaggcttctggatacatcttcaacgtntatacatccactgggtncgcacggccctggtcaagggccngagtgggtggctcataccaacccaacacgtcgcgacaacaaactcgtacgacaacgaagtaacctttcgagggcgacggggtaccccaccagtacggaacccggactaaacccgtaccaataccaaataccaacgtccctaacagtacggaacctgaagtagaacgtaaaanctagacgtacgaccgacctacgttaactactggtacgggacgtaaggacggacgaaggtacgttacccgaggttaacggggtaagtaacggtcggtaccgcgttaacgtttacggaagttcggttctttaaggtaattagttcgggacggggtaaccggtaaagggaacttaacggtcggttaccgttaacccggttcttaacccg

SEQ ID NO: 431645 - DNA, 777 bp, Homo sapiens
  misc_feature: GZ8MTXP01C5JUW.39.73.G07.1.454.CMB.2.raw
  modified_base (221)..(221): a, c, t, g, unknown or other
  modified_base (257)..(257): a, c, t, g, unknown or other
  modified_base (282)..(282): a, c, t, g, unknown or other
tcagtcgcactagtcacgaccggtgctcgatttagctctacgctcagggggtttctctagagaaacccctgagagctccgttcctcaccatggactggacctggaggatcgtcttcttggtggcagcagtcacaggagccccctccaggtgaaattggtgcagtctggctttgaggtgaggaagccgtggggcctctctgaaagtcccctgccaggccttntggatacatcttcaacgtctatacatccactgggtncgcaggccctggtcaagggctgagnggtggctcatcaacccaacactggacgacaacgaaaactctacgacaaccgaaggaaaccttttcgaacggggtccgaaggggttaccccaacccgaaagttcgggaaaccccggggtaacgaaaaccgttacccaatttacccgaaaatttaaaccgggaaacgtccccgtaaacctaaacgtagggaaacccttacgaaacggtttaaagggaaaccgttaaaaaaagttaccctaggaaacccgggtaacaaacccgggggtccccgttaacgttaagttaaacccttagggttcgggtacggaaagggaacggggtaaacgaaaggtaacgttaaccggtaacggtaaggggtaaacgtaaaggtaccgtacgtacgttaacgttaacgttagttacgttacgtttacgttaagttacgttacggttacggggtaacggtaaacgggtaacgtaaacggttacggttaccgtaaccgttaaccgttaaccg

SEQ ID NO: 431646 - DNA, 641 bp, Homo sapiens
  misc_feature: GZ8MTXP01AZLQ0.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctcccaggtgaaattggtgcagtctggctttgaggtgaggagcctggggcctctctgaaacgtcccctgccaggcttctggatacatcttcaacgtctattacatccagtgggtcgcgccacggcccctggtcaagggcctggaggtgggtggctccatccaacccacacgtcgcgacacaactctgacacagtacttcgaggtcacggtacccacacgtcggacccggacaacgtccgaataccaaatacacgcctaacagtacgaactcgaagtacgtaacgtaaacgtcgtacggaacgacgtaccggacgttactacttacgtgtcgggtacgaggacgcgaagtacgttaccgacggttagggtaacgttaaaggtcggtacctcgtaagtttaccggttattagttccgttttagtagttacgttccgggttaggggtaacccgaaagggggtaactacggttacggttaccgttaaccgttccgtttaaccg

SEQ ID NO: 431647 - DNA, 601 bp, Homo sapiens
  misc_feature: GZ8MTXP01DFXRX.39.73.G07.1.454.CMB.2.raw
  modified_base (255)..(255): a, c, t, g, unknown or other
  modified_base (277)..(277): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (298)..(298): a, c, t, g, unknown or other
  modified_base (315)..(315): a, c, t, g, unknown or other
  modified_base (320)..(320): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggaagcctggggcctctctagaaacgtcccctgccaggcttctggatacatcttcaacgtctatacatccatggtncgcaggccctggtcaggcctgngtggngcncanccaacccaancgtgacgacacaactcngcaanacgtacttcgaggcacggtacccaccgatccggaacccggacaaccgtaccaatacaaatacacgacctacagtacgaactacgagtaacgacgtaaaactctaacgacgacgaccggccgttactaagttacgtcgtgggacgaggagacgagtacgtacgacgttaggggaactaaggtcgcgtcttaagttcgttagttcggttacttttggacttaggttcggttacggggtaacctaaagggaactaacggtcgttacctaaccggttcttaaccg

SEQ ID NO: 431648 - DNA, 587 bp, Homo sapiens
  misc_feature: GZ8MTXP01A8E05.39.73.G07.1.454.CMB.2.raw
  modified_base (257)..(257): a, c, t, g, unknown or other
  modified_base (307)..(307): a, c, t, g, unknown or other
  modified_base (400)..(400): a, c, t, g, unknown or other
  modified_base (504)..(504): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctccaggtgaaattggtgcagtctggctttgaggtgaggaagcctggggcctctctgaaagtcccctgccaggcttctggatacatcttcaaacgtctattacatccactgggtcncgccaggcccctggtcaagggcctgagtgggtggctcatccaaccccaanactgcgacaacaaactctgcaacagaactttcgagggtacgaggtcccgaccatccggaacccgggacaaaccgttccaactcaaactacganacctacatacggactacagtagacgtaaatcacgacgacacggccgtactattactgtcggcgagaggacagacgttccgagtaggggtataaaggttgaccgntaagtttacgagtgttactttagtattagttccgttggggaaccgaaggtaacgaacgtagttaccgtaaccgttccgttccg

SEQ ID NO: 431649 - DNA, 721 bp, Homo sapiens
  misc_feature: GZ8MTXP01CLKWM.39.73.G07.1.454.CMB.2.raw
  modified_base (627)..(627): a, c, t, g, unknown or other
  modified_base (648)..(648): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgcccccctccaggtgaaattggtgcagtctggctttgaggtgaggagccgtgggcctctctgaacgtccctgccaggtcttcgtggatactattcttacaacgttctattacactccagttgggtacgccgccgacggtccctggtacgaacgggcctggaggttcggggtcggctacccgtagtaccccgaacccctaacggacgtacggaccgtaacaaccaaactcgtacggaccaacgtaacggtaaccgtttacggaacgggtccgtaacgggtaccccaaccgtagtacccggaaaccccgggactaaacccggttacccaataccctaaacgtaccgaccggtaccctaacgtaacgtaacgggtaacccttagtaacggtaagtaaccgttaaaacttcgtaaccggaaaccgtacgacccggtaccttacgtaacttacgtgtacggcggaaaggcgacgaggtacgtccgagtagggtanaggtcgacgtctaagtttcgngtttacgttcgtttagacgttaggttcgttacgggaatacggtaactcgtacggttacctccgttaacttccg

SEQ ID NO: 431650 - DNA, 311 bp, Homo sapiens
  misc_feature: GZ8MTXP01DP92S.39.73.G07.1.454.CMB.2.raw
  modified_base (256)..(256): a, c, t, g, unknown or other
  modified_base (304)..(311): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagcgggctggcaaggcgcatagnnnnnnnn

SEQ ID NO: 431651 - DNA, 529 bp, Homo sapiens
  misc_feature: GZ8MTXP02HJU33.39.73.G07.1.454.CMB.2.raw
  modified_base (256)..(256): a, c, t, g, unknown or other
  modified_base (307)..(307): a, c, t, g, unknown or other
  modified_base (365)..(365): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaaacctggggcctctctgaaagtcccctgccaggcttctggatacatcttcaacgtctattacatccactgggtncgccaggcccctggtcaagggcctgagtgggtggctccgatcaaccccaanactggcgacacaaaactctgcacagaactttcaggcagggtcacccatgacccggganacgtccatcaatacagacctacataggaactcaagtagacgtaaaatctagacgacacgcgtactatactgtgcgagagcagagtccacgtagggataagtgcgcattcgatgctttagatatcgtagggccaaagggacaagtcggtactaccggtctcttcg

SEQ ID NO: 431652 - DNA, 245 bp, Homo sapiens
  misc_feature: GZ8MTXP02IUKTF.39.73.G07.1.454.CMB.2.raw
  modified_base (244)..(245): a, c, t, g, unknown or other
tcagtcgcactagtcacgaccggtgctcgatttagctctacgctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccactagtgcgactgagcgggctggcaaggcgcatagnn

SEQ ID NO: 431653 - DNA, 528 bp, Homo sapiens
  misc_feature: GZ8MTXP02HMUTE.39.73.G07.1.454.CMB.2.raw
  modified_base (330)..(330): a, c, t, g, unknown or other
  modified_base (370)..(370): a, c, t, g, unknown or other
  modified_base (444)..(444): a, c, t, g, unknown or other
  modified_base (474)..(474): a, c, t, g, unknown or other
  modified_base (503)..(503): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtgcgccaggcccctggtcaaggggcctggagtggggtggcgtccagtccaaccccaacactggcgacacaaactcngcacagaactttcagggcagggtccaccatcgacccgganaccgtcatcaaatacagcctacatcgaactcagtagacgtaaaatcctagacacacggccgtactattactgtncgagagcagacgttccagtggggataaggngcactacgttgatcgtcgtttgatctcgnggaacgaggacagtgactacgtctc

SEQ ID NO: 431654 - DNA, 535 bp, Homo sapiens
  misc_feature: GZ8MTXP02GN9PN.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtgcgccaggcccctggtcaagggcctgagtggtggctccatccaaccccaacactggcgacacaaactctgcacagaactttcaggcagggtccaccatcgacccgggacaccgtccatcaaatacagcctacatcggaactcagtagacgtaaaatctagacgacacggccgtactattactgtgcgagaggcagacgttccacgtggggataagtgcgcatttcgatgtctttgatatcgtggggaaccgaagggacaagtcggtacaccggtcttccg

SEQ ID NO: 431655 - DNA, 524 bp, Homo sapiens
  misc_feature: GZ8MTXP02FPOUC.39.73.G07.1.454.CMB.2.raw
  modified_base (256)..(256): a, c, t, g, unknown or other
  modified_base (370)..(370): a, c, t, g, unknown or other
  modified_base (465)..(465): a, c, t, g, unknown or other
  modified_base (483)..(483): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggtggctccagtcaaccccaacactgcgacacaaactctgcacagaactttcaggcagggtccaccatgacccgggacacgtccntcaatacagcctacatgaactcagtagacgtaaaatctagacgacacggccgctattactgtgcgagaggcagagtccaacgtggggattaaggngacgctacttcgatcgtnttagtatatcgtggcgacggacgacgtagtacgtacgtctc

SEQ ID NO: 431656 - DNA, 535 bp, Homo sapiens
  misc_feature: GZ8MTXP02JTRUK.39.73.G07.1.454.CMB.2.raw
  modified_base (395)..(395): a, c, t, g, unknown or other
  modified_base (400)..(400): a, c, t, g, unknown or other
  modified_base (431)..(431): a, c, t, g, unknown or other
  modified_base (462)..(462): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgcccaggcttctggatacatcttcaacgtctattacatcactgggtgcgccaggcccctggtcaaggggcctggagtgggtggctccatccaaccccacactggcgacacaaactctgcacagtaacttcgaggcagggtccaccatcgacccggacacgtcatcaatacagcctacatggaactnagtanacgtaaatctagacacgacggctctattacngtgcgagagcagacgttccagtagggatagngcgctattcgatcgtctttagattacgtcgtaggggaacctaaggggtacaagtcggacctaccggtcttacc

SEQ ID NO: 431657 - DNA, 359 bp, Homo sapiens
  misc_feature: GZ8MTXP02F7K2C.39.73.G07.1.454.CMB.2.raw
  modified_base (355)..(359): a, c, t, g, unknown or other
tcagtcgcactagtcacgaccggtgctcgatttagctctacgctcagggtcaccatgacccgggacacgtccatcaatacagcctacatggaactcagtagcgtaaaatctgacgacacggccgtctattactgtgcgagaggcagagttccactggggataagtgcgcatttcgatgcttttgatatctggggccaagggacaatggtcaccgtctcttcagcctccaccaaggcccatcggtcttcccctgcaccctcctccaagagcacctctggggcacagcggcccctgggctgcctggtcaaggactacttccactagtgcgactgagcgggctggcaaggcgcatagnnnnn

SEQ ID NO: 431658 - DNA, 593 bp, Homo sapiens
  misc_feature: GZ8MTXP02FR138.39.73.G07.1.454.CMB.2.raw
  modified_base (258)..(258): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagccgtggggcctctctgaaacgtcccctgccaggcttctggatacatcttcaacgtctattacatccactgggtncgccaggcccctggtcaagggcctgaggtgggtggctccgatccaacccccaacactggcgacacaaactctgcacagaaacctttcagggcaggtcccaccatcgacccgggacacgtccatacaaatacacgaccctaacgatacggaaactcaaggtagacgtaaaatctagaccgaacgaccggtccgtactacgttactgtagcggagaggacgagacgttaccgacgtggggtataaggtgacgactagtttcgattcgtctttagagttacgtcggtacggggaaccgaaagggtaacgtaagttcggtacgacccggttcttacccg

SEQ ID NO: 431659 - DNA, 545 bp, Homo sapiens
  misc_feature: GZ8MTXP02GHE45.39.73.G07.1.454.CMB.2.raw
  modified_base (257)..(257): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactggggtncgccaggcccctggtcaagggcctgagtgggtggctccgatccaaccccacactggcgacacaaactctgcacagtaactttcagggcagggtccaccatcgaccgggacacgtccatcaatcagccctacatacggaactcagtagacgtaaaatctagacgacacggccgtactatactgtgcgagaggacagacgttccgacgtggggaataaggtgcgtctacgttcgatcgtctttgactacgtcgtagggcgaagggactaacgtggtacaccggtctaccg

SEQ ID NO: 431660 - DNA, 528 bp, Homo sapiens
  misc_feature: GZ8MTXP02JGHOT.39.73.G07.1.454.CMB.2.raw
  modified_base (256)..(256): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggtggctccatccaaccccaacactggcgacacaaactctgcacagaactttcagggcagggtccaccatcgacccggacacgtcatcaaatacagcctacatggaaactcagtagacgtaaaatctagacgacacggccgtctattactgtgcgagaggcagagttccacgtgggataagtgcgctagtttcgattgctttgatatcgtggggaaccaagggacaagtggtacacgtctacg

SEQ ID NO: 431661 - DNA, 584 bp, Homo sapiens
  misc_feature: GZ8MTXP02IO878.39.73.G07.1.454.CMB.2.raw
  modified_base (257)..(257): a, c, t, g, unknown or other
tcagtcgcactagtcacgaccggtgctcgatttagctctacgctcaggggtttctctagagaaacccctgagagctccgttcctcaccatgggctggacctggaggatcgtcttcttggtggcagcagtcacaggagccccctcccaggtgaaattggtgcagtctgactttgaggtgaggaagcctggggcctctctgaaagtccctgccaggcttctggatacatcttcaacgttctattacatccactggggtncgcccaggccccctggtcaagggcctgaggtgggtggctccatccaaccccaacacgtggacgacacaaactctgacacagaactttcagggcagggtcccacagtcgacccggacaccgtcatcaaatccagcctacatacggaactcgaagtacgacgtaaaactcgtagaccgacaccggtccgtacttaacttaccgtgtcgacgagacggacagacgttccgacgtaggggataaggtgacgactagtttcgatcgttcgtttagtactagtcgtacggggaaccgtaaagggactaacgtcggtacctaccggttctaccg

SEQ ID NO: 431662 - DNA, 560 bp, Homo sapiens
  misc_feature: GZ8MTXP02FY638.39.73.G07.1.454.CMB.2.raw
  modified_base (411)..(411): a, c, t, g, unknown or other
  modified_base (465)..(465): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactggtgcgccaggcccctggtcaagggcctgagtggtggctccatcgaaccccaacactgcgacacaaactctgcacagaacttcaggcaggtccacatgacccggacacgtccatcaatacagcctacatgaaactcagtagacgtaaaatctagaccganacgccgtacattactgtgcgagaggacagaagttccagttaggggaattaaggngacgtacgtacgtttacgtattgtacgtttagtacgttacgtcggtacgggaaccgtaaacgggtacgtaacggttcgtaccgtaccgttactcg

SEQ ID NO: 431663 - DNA, 597 bp, Homo sapiens
  misc_feature: GZ8MTXP02JO3UC.39.73.G07.1.454.CMB.2.raw
  modified_base (374)..(374): a, c, t, g, unknown or other
tcagtcgcactagtcacgaccggtgctcgatttagctctacgctcaggggtttctctagagaaacccctgagagctccgttcctcaccatgggctggacctggaggatcgtcttcttggtggcagcagtcacaggagccccctcccaggtgaaattggtgcagtctgactttgaggtgaggaagcctggggcctctctgaaagtcccctgccaggcttctggatacatcttcaacgtctattacatccactgggtgcgccaggcccctggtcaagggcctgagtgggtggctccagtccaaccccacacgtggcgacacaaactctgcacagactttcgagggcaggtccccacagtcgacccggacacgtccntcaaatacacgcctacataggaactcagtagtacgtaaatctagacgtacacggccgtactacttacgtgtacgcgagaggcacgagttccaacggttggggaataacggtgacgctaagtttcgaagttcgtcgttttagattaacgttcgttacgggggtaacccgaaaacgggtaacgtaaacggttcggtaaacccgtaccgggtttccgtttaacccg

SEQ ID NO: 431664 - DNA, 614 bp, Homo sapiens
  misc_feature: GZ8MTXP02J3W1W.39.73.G07.1.454.CMB.2.raw
  modified_base (257)..(257): a, c, t, g, unknown or other
  modified_base (307)..(307): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactggggtnccgccaggcccctggtcaagggcctgagtgggtggctccatcaaccccanactggcgacacaactctgcaacagtaacctttgacggggcgagggtcccaccactcgacccggggacaccgtccactacaaataccacgacctacagtacgaactacgagtaagacgtaaaatactagaacgacgaccggtccgtacttattactagttcggcggaggaggacgagtacgttccgtacgtacggggtaaggtaaagtcggcgtacgtacgtttacgtagttgttctttagttagtacgtcgttcgggggaaccgaacggggaacgtaacgtacgtccggttacccttaccgtttccc

SEQ ID NO: 431665 - DNA, 536 bp, Homo sapiens
  misc_feature: GZ8MTXP02G76T1.39.73.G07.1.454.CMB.2.raw
  modified_base (291)..(291): a, c, t, g, unknown or other
  modified_base (307)..(307): a, c, t, g, unknown or other
  modified_base (394)..(394): a, c, t, g, unknown or other
  modified_base (448)..(448): a, c, t, g, unknown or other
  modified_base (468)..(468): a, c, t, g, unknown or other
  modified_base (480)..(480): a, c, t, g, unknown or other
  modified_base (529)..(529): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgtctattacatccactgggtgcgccacggcccctggtcaagggcctggaggtggnggctcatccaacccanactggcacaacaactctagacacagtaacttcgagggcaggtccaccatcggacccgggacaccgtccatacaactacacgcctaanatacggaactcaagtagacgtaaaatcgtagacgacgacggcctactatactgngtcgagagcagacgtcgagngggatagtcgcncgtatttcgatgtcttgatacgtgtacgggcgtaaggactagtcgtacncgtctcg

SEQ ID NO: 431666 - DNA, 357 bp, Homo sapiens
  misc_feature: GZ8MTXP02JYLYL.39.73.G07.1.454.CMB.2.raw
  modified_base (354)..(357): a, c, t, g, unknown or other
tcagtcgcactagtcacgaccggtgctcgatttagctctacgctcagggtcaccatgacccgggacacgtccatcaatacagcctacatggaactcagtagcgtaaaatctgacgacacggccgtctattactgtgcgagaggcagagttccactggggataagtgcgcatttcgatgcttttgatatctggggccaagggacaatggtcaccgtctcttcagcctcaccaagggcccatcggtcttcccctggcaccctcctccaagagcacctctggggcacagcggcctgggctgcctggtcaaggacacttccactagtgcgactgagcgggctcggcaaggcgcatagnnnn

SEQ ID NO: 431667 - DNA, 572 bp, Homo sapiens
  misc_feature: GZ8MTXP02FQBYP.39.73.G07.1.454.CMB.2.raw
  modified_base (256)..(256): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggtgggctccgatcaaccccaacactggacgacacaaaactctgcacagaactttcagggcagggtccaccatcgacccggacacgtcatcaatacacgcctacatggaactcagtagacgtaaaatctagacgaacaccggcgtactattaacctgtcgacgagacggacgagacgttccacgtaggggataaggtgcgcgtatttcgattacgtctttttaggacttaagtcgttagggggaacccgaaaggggaactaagtaggtactaaccggtctttacccg

SEQ ID NO: 431668 - DNA, 554 bp, Homo sapiens
  misc_feature: GZ8MTXP02HAV6Y.39.73.G07.1.454.CMB.2.raw
  modified_base (305)..(305): a, c, t, g, unknown or other
  modified_base (321)..(321): a, c, t, g, unknown or other
  modified_base (350)..(350): a, c, t, g, unknown or other
  modified_base (366)..(366): a, c, t, g, unknown or other
  modified_base (372)..(372): a, c, t, g, unknown or other
  modified_base (376)..(376): a, c, t, g, unknown or other
  modified_base (390)..(390): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgtctattacatccactgggtgcgccaggcccctggtcaagggcctgagtcggcgcgtcagtccacccanactggcacacaactcngactacagacttcgaggcaggtccaccgnacgaccggacacgacnctcaanacanccacagtagaaccnagtagataaatctgacacgacgcgtacactagtggtacgagagagacgacgtacgtacgtacgtacggtagtacgtacgcgtacgtacgttacgtagtacgttacgttacgtacgtacgtacggtacggtaacgtacggacgtacgtacgtacgtacgtactcg

SEQ ID NO: 431669 - DNA, 570 bp, Homo sapiens
  misc_feature: GZ8MTXP02H96T8.39.73.G07.1.454.CMB.2.raw
  modified_base (196)..(196): a, c, t, g, unknown or other
  modified_base (290)..(290): a, c, t, g, unknown or other
  modified_base (373)..(373): a, c, t, g, unknown or other
  modified_base (409)..(409): a, c, t, g, unknown or other
  modified_base (422)..(422): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagcccccctcccaggtgaaattggtgcagtctggctttgaggtgaggaagcctggggcctntctgaaagtcccctgccaggcttctggatacatcttcaacgtctattacatccactgggtgcgccaggcccctggcaagggcctggaggtgggnggctccatcccaaccccaacacgtggcgaacaacaaactctgacacagactttcgaagggcaggtcccacagtcgacccgganacgtcccatacaaataccagcctaacatcgaaactnagtagactaaaanctagacgacacggtaccgtctatactgtacgacggagaggacagtacgttaccaggtaggggattaaggtgacgctattcggatgttactttagtatacgttcgtaggggaaccgtaagggacaagtcggtacctaccggttctaccg

SEQ ID NO: 431670 - DNA, 533 bp, Homo sapiens
  misc_feature: GZ8MTXP02GZLWX.39.73.G07.1.454.CMB.2.raw
  modified_base (256)..(256): a, c, t, g, unknown or other
  modified_base (286)..(286): a, c, t, g, unknown or other
  modified_base (302)..(302): a, c, t, g, unknown or other
  modified_base (366)..(366): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgcaggcccctggtcaagggcctgagtggnggctcatcaaccccanactggcgacacaaactctgcacagaactttcgaggcaggtccaccatcgacccggacacgtccntcaaatacagcctaacatagaactcagtagacgtaaaatctagacgacacggaccgtctattactgtgcgagaggcagacgttaccgagtggggataagtgcgcgtattcgatcgtctttagactagtcgtaggggccaaggggacaagtcggtacaccgtcttccg

SEQ ID NO: 431671 - DNA, 703 bp, Homo sapiens
  misc_feature: GZ8MTXP02G90X0.39.73.G07.1.454.CMB.2.raw
  modified_base (506)..(506): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttacaacgtctattacatccactgggtgcgccgacggcccctggtcgaacgggcctggaggtggggtcggcctccactacccaaccccaacacgtcggaccgaaccaaccaaactctacgaccaacagtaacctttacgacggggacgacgggtccccaccgacgtacggaccccggacaccggtcactacaaactaccacgacctacagtacgaactcgaagtacgaacgtaaatccgtagaccgaacgaccgggtaccttactacgtttaccgnggtacggacggtaaggacggacgtaacggtaccggttacccgaagggttagggggaaattaacgggttgaccggttacgttaacggttttaccggatttacggtttcgttttacggaattacggttaccgggtacgggggaacccgtaaaaggggtaccgtaagggttaccgtacccgttaccggtttcttacccgg

SEQ ID NO: 431672 - DNA, 566 bp, Homo sapiens
  misc_feature: GZ8MTXP02G6BQ3.39.73.G07.1.454.CMB.2.raw
  modified_base (394)..(394): a, c, t, g, unknown or other
  modified_base (402)..(402): a, c, t, g, unknown or other
  modified_base (441)..(441): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtgcgccaggcccctggtcaagggcctgagtgggtggctccatccaaccccaacactggcgaacacaaaactctgacacagaacctttcagggcagggtccaccgatcgacccgggacaccgtccatacaatacagcctanatgaactnagtagacgtaaaatcagacgacacggccgtctacttacngtgcgagagcagacgtccgacgtgggaatagtacgcgacgtagtttacgtagttaggtctttagtagttaacttcggtacgggtaaccgaagggtaactaagtcggtaccaccggttcttacccg

SEQ ID NO: 431673 - DNA, 602 bp, Homo sapiens
  misc_feature: GZ8MTXP02F4HCS.39.73.G07.1.454.CMB.2.raw
  modified_base (256)..(256): a, c, t, g, unknown or other
  modified_base (287)..(287): a, c, t, g, unknown or other
  modified_base (291)..(291): a, c, t, g, unknown or other
  modified_base (302)..(302): a, c, t, g, unknown or other
  modified_base (318)..(318): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtggnggcncagtcacccanactgcgacacaactcngcacagaacttcagggcagggtccaccgatcgacccgggacaccgtccagtaccaaataccaagccctaaacgacgtacgaacctacgaacgtaacgaacgtaaaatcgtacgaaccgacgaccggtaccgtactacgttacgtagtacgacgaagacggtacgagtacgtaccgaggtacgggaataggtcgtacgtacgtacgttacgtagtacgttacgttacgtacgtacgtacgtacggtaacggaacggtaacgtacgtacgtacgtaccgtacgtcg

SEQ ID NO: 431674 - DNA, 545 bp, Homo sapiens
  misc_feature: GZ8MTXP02JTZAP.39.73.G07.1.454.CMB.2.raw
  modified_base (266)..(266): a, c, t, g, unknown or other
  modified_base (344)..(344): a, c, t, g, unknown or other
tcagtcgcactagtcacgaccggtgctcgatttagctctacgctcagggtcttcgtggctcacgtccaccaccacgcatgtgacctcaggggtccgggagatcatgagggtgtccttgggttttgggggaagaggaagactgacggtcccccaggagttcaggtgctgggcacggtgggcatgtgtgagttttgtcacaagatttgggctcaactctcttgtccagtccctggtgcagctgctgcagtcgggactgaggtgaaggngcctgggtcctcggtgaggggtctccgtgcaaggctttctgggaggcaccttcggcaactatcctatcaccgtgggtncgacaggccccccctggagaaggtacttgaggtggggtggggaggcatcatccctgctttgctacacccaacctcgacacacgaaacttccaaggcagagtacacgactttccgctgacgaatccaacgaacacggcctatctagaactgagcacgacttaacgctagacgaacacggacctatttataccttgacgaacg

SEQ ID NO: 431675 - DNA, 524 bp, Homo sapiens
  misc_feature: GZ8MTXP02IQGFV.39.73.G07.1.454.CMB.2.raw
  modified_base (258)..(258): a, c, t, g, unknown or other
  modified_base (309)..(309): a, c, t, g, unknown or other
  modified_base (372)..(372): a, c, t, g, unknown or other
  modified_base (440)..(440): a, c, t, g, unknown or other
  modified_base (468)..(468): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagcccccctcccaggtgaaattggtgcagtctgactttgaggtgaggaagcctggggcctctctgaaacgtcccctgccaggcttctggatacatcttcaacgtctattacatccactgggtncgccaggcccctggtcaagggcctgagtgggtggctccatccaaccccaanctggcgacacaaactctgcacagaactttcagggcaggtccaccatcgacccggacacgtccntcaatacagcctacatggaactcagtagacgtaaaatctagacgacacggccgtctatactgtgacgngaggcagacgtcacgtgggatagtgcgntagttcgatgtctttgattactcgtagggaacgaaggacatggactacgtcttacg

SEQ ID NO: 431676 - DNA, 625 bp, Homo sapiens
  misc_feature: GZ8MTXP02I8YKM.39.73.G07.1.454.CMB.2.raw
  modified_base (374)..(374): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccatgggtgcgccaggcccctggtcagggcctgaggtggtggctcatccaacccacactggcgacacaaactctagcacagtaactttcgaggcaggtcccaccagtcggaacccgggacaccgtccngtaccaaataccacgtcctaacagtacggaactcgaagtacgacgtaaaactcgtacgacgaccgacggtccgtactacttacgtgttagacggagtacggacgaagtacgttaccgacggtagggggaattacggtagcgtacgtacgtttacggattcggttactttacggtacgtttaagttccgtacgggggtaaccgtaaacggggtaacgtaaaggttccggtacgtacccggtttctttacccg

SEQ ID NO: 431677 - DNA, 367 bp, Homo sapiens
  misc_feature: GZ8MTXP02HMKAH.39.73.G07.1.454.CMB.2.raw
  modified_base (362)..(367): a, c, t, g, unknown or other
tcagtcgcactagtcacgaccggtgctcgatttagctctacgctcagggcagggtcaccatgacccgggacacgtccatcaatacagcctacatggaactcagtagcgtaaaatctgacgacacggccgtctattactgtgcgagaggcagagttccactggggataagtgcgcatttcgatgcttttgatatctggggccaagggacaatggtcaccgtctcttcagcctccaccaaggcccatcggtcttcccctggcaccctcctccaagagcacctctggggcacgagccggccctgggctgcctggtcaaggactacttccactagtgcgactgagccgggctggcaaggcgcatgnnnnnn

SEQ ID NO: 431678 - DNA, 623 bp, Homo sapiens
  misc_feature: GZ8MTXP02HJEHH.39.73.G07.1.454.CMB.2.raw
  modified_base (256)..(256): a, c, t, g, unknown or other
  modified_base (281)..(281): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgcagccctggcaggctgagtgggnggctccatccaaccccacacgtggccgacaacaaactctagccacaagtactttcgacgggtcacggtcccaccgagtcggaaccccgggacaccgtacagtaccaaacgtaccacgaccctaagactacggaactacgaagtacgacgtaaaatcgtagacgacacggccgtactacttacgtcgtagacgaagaggacgacgtacgttaccgacggtacgggggtaataacggtcgtacggacttaacgtttcgaagttcggttctttttagacgttacgtcggtacgggggtaaccgaacggggaactaacggttagggtacctaccggtttacttccg

SEQ ID NO: 431679 - DNA, 573 bp, Homo sapiens
  misc_feature: GZ8MTXP02GIOAP.39.73.G07.1.454.CMB.2.raw
  modified_base (256)..(256): a, c, t, g, unknown or other
  modified_base (283)..(283): a, c, t, g, unknown or other
  modified_base (286)..(286): a, c, t, g, unknown or other
  modified_base (289)..(289): a, c, t, g, unknown or other
  modified_base (300)..(300): a, c, t, g, unknown or other
  modified_base (303)..(303): a, c, t, g, unknown or other
  modified_base (315)..(315): a, c, t, g, unknown or other
  modified_base (380)..(380): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgtctattacatccatgggtncgcaggcccctggtcagggcctggagnggngcncagcaacccanacngcacacaactcngcacagtacttcgaggcaggtccaccatcggaccggacacgtcataccaaatacacgaccctaanacgtacgaaactcgaagtaacgaacgtaaactcgtacgaccgacgacgtaccgtactattacgtgtaggacggagacggacgagtacgtacgtacggtaggtagtagtgcgtcgtacgttacgtagtacgttagttagtacgtacgtcggtacgggaacggaacggacgtacgtacgtacgtaccgtacgtcg

SEQ ID NO: 431680 - DNA, 599 bp, Homo sapiens
  misc_feature: GZ8MTXP02JWFR1.39.73.G07.1.454.CMB.2.raw
  modified_base (257)..(257): a, c, t, g, unknown or other
  modified_base (288)..(288): a, c, t, g, unknown or other
  modified_base (305)..(305): a, c, t, g, unknown or other
  modified_base (321)..(321): a, c, t, g, unknown or other
  modified_base (325)..(325): a, c, t, g, unknown or other
  modified_base (349)..(349): a, c, t, g, unknown or other
  modified_base (359)..(359): a, c, t, g, unknown or other
  modified_base (367)..(367): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtggnggctcagtcaaccccanacgtgcacacaactcngcanacgaacttcagggcaggccaccancgacccgganacgtccanacaatacacgctacactacgactacgagacgtaacgtaaacgggggtcacgacgaacgaccgtaccgtactacttacgtcgtagcgagacggacgacgtacgtaccgtacggtacgggtaacggtaagtacgtacgtacgtacgttacgtacgtacgttacgtttacgttacgttacgttcggtacgggtaaccggtaacggtaacgtacgtacgtacgtaccgtaccgtcg

SEQ ID NO: 431681 - DNA, 579 bp, Homo sapiens
  misc_feature: GZ8MTXP02GJAA2.39.73.G07.1.454.CMB.2.raw
  modified_base (256)..(256): a, c, t, g, unknown or other
  modified_base (308)..(308): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctggagtgggtggctccatccaaccccaanacgtggcgacacaaactctgcacagtaaccttcgaggggcagggtcccaccagtcggacccgggacacgtccatccaaatacagcctaacatcggaaactcagtagacgtaaaatcgtagacgacacggctactattactgtgacgagaggcagacgttccgacgtggggtaataagtgcgtacgtagtttcgattggtcttttgacgttattcggtacgggggaacctaaagggggactaaacggtggtacccgtaccggttctttcccg

SEQ ID NO: 431682 - DNA, 547 bp, Homo sapiens
  misc_feature: GZ8MTXP02GR14B.39.73.G07.1.454.CMB.2.raw
  modified_base (255)..(255): a, c, t, g, unknown or other
  modified_base (388)..(388): a, c, t, g, unknown or other
  modified_base (471)..(471): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctccaggtgaaattggtgcagtctggctttgaggtgaggaagcctggggcctctctgaaagtcccctgccaggcttctggatacatcttcaacgtctattacatccactgggtncgccaggcccctggtcaagggcctgagtgggtggctccatccaaccccacactggcgacacaaactctgcacagaactttcgagggcagggtccaccagtcgacccgggacacgtccatcaatacagccctanatcggaactcagtagacgtaaaatctagacgacaccggccgtactattactgtgcgagagcagacgtccgacgtggggatagngcgctagttcgattagtctttgacttacgtcgtcgggaaccgtaagggactaacgtcggtacctaccgttcttacg

SEQ ID NO: 431683 - DNA, 534 bp, Homo sapiens
  misc_feature: GZ8MTXP02JUQPI.39.73.G07.1.454.CMB.2.raw
  modified_base (290)..(290): a, c, t, g, unknown or other
  modified_base (459)..(459): a, c, t, g, unknown or other
  modified_base (465)..(465): a, c, t, g, unknown or other
  modified_base (480)..(480): a, c, t, g, unknown or other
tcagtcgcactagtcacgaccggtgctcgatttagctctacgctcaggggtttctctagagaaacccctgagagctccgttcctcaccatgggctggacctggaggatcgtcttcttggtggcagcagtcacaggagccccctcccaggtgaaattggtgcagtctgactttgaggtgaggaagcctggggcctctctgaaagtcccctgccaggcttctggatacatcttcaacgtctattacatccactgggtgcgccaggcccctggtacaagggcctgaggtgggnggctccagtccaaccccaacacgtggcgacacaaactctgcacagaacttcagggcaggtccacatcgaccggacacgtcatcaatacagcctacatacgaactcagtagacgtaaatctagacgacacggcctactattactgtgcgagagcagacgtcacgtggganagtgcnctattcgattcgttnttagactacgtcgtacgggaacgaacggaacgtacgtcgtaccgtacgtacgtc

SEQ ID NO: 431684 - DNA, 566 bp, Homo sapiens
  misc_feature: GZ8MTXP02GL06J.39.73.G07.1.454.CMB.2.raw
  modified_base (288)..(288): a, c, t, g, unknown or other
  modified_base (325)..(325): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtgcgccaggcccctggtcaagggcctgagtgggnggctccagtccaacccaacacgtgcgacacaaactcngcacagactttcaggcagggtcccacatcgacccggacacgtccatcaatacagcctacatcggaactcagtagacgtaaaatctacgacgacgacggcctactattactgtacgacgagaggacgagagttaccacgtaggggacttaaggagacgactacgttcgattcgtacgtttagtacgtacgtcgtacgggtaacggaacgggaacgtacgtacggtaccgtaccgtacgtacg

SEQ ID NO: 431685 - DNA, 545 bp, Homo sapiens
  misc_feature: GZ8MTXP02JVRX8.39.73.G07.1.454.CMB.2.raw
  modified_base (256)..(256): a, c, t, g, unknown or other
  modified_base (289)..(289): a, c, t, g, unknown or other
  modified_base (366)..(366): a, c, t, g, unknown or other
  modified_base (388)..(388): a, c, t, g, unknown or other
  modified_base (449)..(449): a, c, t, g, unknown or other
  modified_base (491)..(491): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgaggtgggnggctccatccaaccccacactggacacacaaactctgcacagaactttcgagggcaggtccaccatcgacccggganaccgtcatcaaatacagcctanatcggaactcagtacgacgtaaaatcgtagacgacgacggccgtactattactgtgcgagngacagacgtccgagtgggatagtgacgctacgttgatcgttnttagtacgtacgtcgtacggtaacgacggacgtacgtacgtacgtaccgtctcg

SEQ ID NO: 431686 - DNA, 559 bp, Homo sapiens
  misc_feature: GZ8MTXP02F89PE.39.73.G07.1.454.CMB.2.raw
  modified_base (307)..(307): a, c, t, g, unknown or other
  modified_base (323)..(323): a, c, t, g, unknown or other
  modified_base (363)..(363): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtgcgccaggcccctggtcaagggcctgagtgggtggctccgatcaaccccaanctggcacacaaactcngcacagaactttcagggcagggtccaccatcgacccgganaccgtcatcaatacagcctacatcgaaactcagtagacgtaaaatctacgacgaacacggccgtactacgttactgtacgcggtaagaggactaagacgttccgtaacgtggggtaactaaggtcgcgactagtttcgattgtactttgattactcgtagggccgtaaggggactaagtggtacaccgtcttaccg

SEQ ID NO: 431687 - DNA, 593 bp, Homo sapiens
  misc_feature: GZ8MTXP02FYPFP.39.73.G07.1.454.CMB.2.raw
  modified_base (257)..(257): a, c, t, g, unknown or other
  modified_base (320)..(320): a, c, t, g, unknown or other
  modified_base (408)..(408): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggagccgtggggcctctctgaaacgtcccctgccaggcttctggatacatcttcaacgtctattacatccactgggtncgccacggcccctggtcaagggcctggaggtcggggtggcgtccgagtccaacccaactacgngacgacaacaactctgacacagtaacttcgaggcagggtccaccgagtacggacccgggacaccgtaccatacaaatacacgacctanagtacggaactcaagtacgacgtaaaatcgtagaccgacgaacggtcctatacttacgtgtcgacgagagacagtacgtccgagtggggtaatagtcgacgtactagttcgtagtcgttactttagactttagtcggtacgggaaccgtaagggactaacgtcggttaccaaccggtttctaccg

SEQ ID NO: 431688 - DNA, 597 bp, Homo sapiens
  misc_feature: GZ8MTXP02H2J8Y.39.73.G07.1.454.CMB.2.raw
  modified_base (261)..(261): a, c, t, g, unknown or other
  modified_base (297)..(297): a, c, t, g, unknown or other
  modified_base (313)..(313): a, c, t, g, unknown or other
  modified_base (335)..(335): a, c, t, g, unknown or other
  modified_base (374)..(374): a, c, t, g, unknown or other
  modified_base (401)..(401): a, c, t, g, unknown or other
tcagtcgcactagtcacgaccggtgctcgatttagctctacgctcaggggttttctctagagaaacccctgagagctccgttcctcaccatggactggacctggaggatcgtcttcttggtggcagcagtcacaggacgccccctcccaggtgaaattggtgcagtctggctttgaggtgaggagcctggggcctctctgaaacgtcccctgccaggcttctggattacatctttacaacgttctattacatccatgggtnccgcacggcccctggtcaagggcctggaggtcgggngctcatccaaccccancgtgcaacacaactctagacanacgtacttcgaggcaggtcccacgactcgaacccggtanacgtaccatcaaatccacgtaccctanagtacgaacctgaagtacaactaaagtctagacgacgtacgccgtatattacgtggacgacgtagagcacgtacgtacgacggttagggaacttaggtcgacgtacgtactttacgtattcgttcgtttacgtacgttacgtacggtacggtaaccggtaacggtaacgtacgtacggtaccgtaccgtacgttcg

SEQ ID NO: 431689 - DNA, 526 bp, Homo sapiens
  misc_feature: GZ8MTXP02F70VO.39.73.G07.1.454.CMB.2.raw
  modified_base (256)..(256): a, c, t, g, unknown or other
  modified_base (305)..(305): a, c, t, g, unknown or other
  modified_base (361)..(361): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtncgccaggcccctggtcaagggcctgagtggtggctcatccaaccccaanactggcacacaaatctgcacagtaacttcagggcagggtccacatcgacccggganacgtccatcaaatacagcctacatacgaactcagtagacgtaaaatctagacgacacggctactattactagtgcgagaggacagacgttcacgtggggataagtgacgctaattcgatgtactttgatatcgtagggaaccaaggacaagtcgtacacgtctac

SEQ ID NO: 431690 - DNA, 567 bp, Homo sapiens
  misc_feature: GZ8MTXP02H86KW.39.73.G07.1.454.CMB.2.raw
  modified_base (258)..(258): a, c, t, g, unknown or other
  modified_base (283)..(283): a, c, t, g, unknown or other
  modified_base (288)..(288): a, c, t, g, unknown or other
  modified_base (292)..(292): a, c, t, g, unknown or other
  modified_base (295)..(295): a, c, t, g, unknown or other
  modified_base (303)..(303): a, c, t, g, unknown or other
  modified_base (317)..(317): a, c, t, g, unknown or other
  modified_base (382)..(382): a, c, t, g, unknown or other
  modified_base (396)..(396): a, c, t, g, unknown or other
  modified_base (404)..(404): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctccaggtgaaattggtgcagtctggctttgaggtgaggaagcctggggcctctctgaaacgtcccctgccaggcttctggatacattcttcaacgtctattacatccactggggtnccgccaggcccctggcagggcctgngtggnggcncanccacccanctgcacacaactcngcacagaactttcgaggcaggtcccaccgagtcgaccgggacaccgtccatcaatacagccctanatacgactcagtanacgtaaanctagacgacgaccggccgtactacttactgtcgacggagaggcagtcgttaccgaggtaggggactaaggcgacgctacgtttcgattcgtcgtttagacttacgtcggtacggggaaccgtaacggggtaactacggttaggtacccgtacggttcttaccg

SEQ ID NO: 431691 - DNA, 307 bp, Homo sapiens
  misc_feature: GZ8MTXP02H7958.39.73.G07.1.454.CMB.2.raw
  modified_base (303)..(307): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaaacgtctattacatccactggtgcgccaggcccctggtcaagggcctgagcggctggcaaggcgcatagnnnnn

SEQ ID NO: 431692 - DNA, 578 bp, Homo sapiens
  misc_feature: GZ8MTXP02IQSFV.39.73.G07.1.454.CMB.2.raw
  modified_base (260)..(260): a, c, t, g, unknown or other
  modified_base (290)..(290): a, c, t, g, unknown or other
  modified_base (305)..(305): a, c, t, g, unknown or other
  modified_base (319)..(320): a, c, t, g, unknown or other
  modified_base (332)..(332): a, c, t, g, unknown or other
  modified_base (337)..(337): a, c, t, g, unknown or other
  modified_base (435)..(435): a, c, t, g, unknown or other
  modified_base (439)..(439): a, c, t, g, unknown or other
  modified_base (486)..(486): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagccgtggggcctctctgaaacgtcccctgccaggcttcgtggatacattcttcaacgtctattacatccactgggtncgccaggcccctggtcagggctgaggtggngctcatccaaccacntggcacacaactcnncacatacttcgnggacncggtccaccgatcggaccgactaccgtcgatcgaaactcgacgtaccacatcggaactgaagtagactaaaatcgagacacgccgacgtacattacgnggtnacggagaggacgtacgacgttacccgagggttacggagttaaccggngtaccgtagttacgttcgtagttcgtttacgtagtacgtacggtcggtaacggtaacgtaacggactacggtacgtacctaccgttactccg

SEQ ID NO: 431693 - DNA, 619 bp, Homo sapiens
  misc_feature: GZ8MTXP02FYOHP.39.73.G07.1.454.CMB.2.raw
  modified_base (333)..(333): a, c, t, g, unknown or other
  modified_base (358)..(358): a, c, t, g, unknown or other
  modified_base (375)..(375): a, c, t, g, unknown or other
  modified_base (393)..(393): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactggggtgcgccaggcccctggtcaagggcctggaggtgggtcggcgtccgaagtccaacccaacacgtggcacgacaaactcncgcacagacttcaggcaggtccacntacgaccggacacgtcntcaaatacagaccctaanacgtacgaactacgaagtaacgaacgtaaactcgtacgaccgtacgaccggtcttactattacgtgtacggacgtagacggtacgacggtacgttaccgaacggttagggtaactacggtcgtacgtacgtacgttacgtagttacgttacgtttacgttacgttacgtacggtacggtaacggtaacggtaacggtaacgtacggtaccgtaccgttacgtaccg

SEQ ID NO: 431694 - DNA, 589 bp, Homo sapiens
  misc_feature: GZ8MTXP02FJ0VQ.39.73.G07.1.454.CMB.2.raw
  modified_base (258)..(258): a, c, t, g, unknown or other
  modified_base (311)..(311): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagcccccctcccaggtgaaattggtgcagtctggctttgaggtgaggaagcctggggcctctctgaaacgtcccctgccaggcttctggatacatcttcaacgtctattacatccactgggtncgccaggcccctggtcaagggcctgaggtgggtggctccatccaaccccaacnctggcacaacaaactctgcacagtaactttcagggcagggtccaccagacgaccgggacaccgtcatcaaatacacgcctaacgatgtaaactcaagtagaacgtaaaatcgtagaaccgacgtaccggcctacttagttacctgtaggcgaagtacggacgaagacgttaccgacgttaggggaataaggtgcgagttacgtacgtacttggttactttagtattaacgtcgtacgggggaacaaggggtaacaacgtgtaccgtaccgtctttccg

SEQ ID NO: 431695 - DNA, 815 bp, Homo sapiens
  misc_feature: GZ8MTXP02H343L.39.73.G07.1.454.CMB.2.raw
  modified_base (258)..(258): a, c, t, g, unknown or other
  modified_base (312)..(312): a, c, t, g, unknown or other
  modified_base (411)..(411): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgtcctattatatacactgggtncgccacggcccctggacaagggcctgagtggatgggatgtatccgaaccccggnggggtcggacgaacaacaaaatatgacaacagagtatttcgagggacacggggtcaccagtcgacgtcggggaactccggtaccaaatacccaaaaacncgtaccctaacgtagtaggaaacttaccgtaagtaacgtaacgtagtaaacgttaaccccgaaacggtaaccggaacccgggtacccgttagttacccgtttacggtacgggtttacgggacggtaaacgggtacggggaccgtaaacggttaccggttacccccgtaaacgggtacggggggttaaaacttaaagggggttaccggtaaaacccgggttttaaagtttttaaacccggggttaaggtttttacgggggttttttaacgggaaaaggtttttcggggtaacccgggtttaacgggggggtaaaccccggtaaaagggggttaacccgtaaaacggggtttccggggttacccgttaaaccccgggggtttcctttaacccggtttaacccccgg

SEQ ID NO: 431696 - DNA, 610 bp, Homo sapiens
  misc_feature: GZ8MTXP02GS58D.39.73.G07.1.454.CMB.2.raw
  modified_base (220)..(220): a, c, t, g, unknown or other
  modified_base (256)..(256): a, c, t, g, unknown or other
  modified_base (285)..(285): a, c, t, g, unknown or other
  modified_base (303)..(303): a, c, t, g, unknown or other
  modified_base (371)..(371): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttcnggatacatcttcaacgtctattacatccactgggtncgccaggcccctggcaggcctgagtgggnggctcatccaaccccacnctggcgacacaaactctgcacagaactttcagggcagggtcccaccatcggacccggacaccgtaccntacaaatacacgcctacatacggaactacgaagtagacgtaaaactcgtagaccgaacaccggtcctacttaacttacgtggtacggacggtaagcggtacgaacggtacgttccgaacggtagggggtaattaacggtacggcgtacgtaacgtttcgagttcgttcgttttagtagttactcggtaggggtaaccgtaacgggaacgtaacgtacggtacctacgttccgtttaccg

SEQ ID NO: 431697 - DNA, 678 bp, Homo sapiens
  misc_feature: GZ8MTXP02GNQIH.39.73.G07.1.454.CMB.2.raw
  modified_base (256)..(256): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgtctattacatccactggtncgccaggcccctggtcaagggcctgagtggtggctcgatcaaccccacactggccgacaacaaactctgacacagtaacctttcgacggggcacggggtcccaaccgacgtcggaacccccggggacaccggttccataccaaataccgagccctaacactacgggaaacctacgaagtagaacgttaaaaatccgtagaccgaaccgacccgggaccgttacttaacgttaccgttgtacgacggtaggacggtacaggtacgttacccgaacggttagggggaaacttaagggtcgtaccgtacgtaagttttcccggaaagttcgttaccgtttttagaacgttacggttcggttaacgggggcccgtaaaaggggtaacctacggttacggtaccgtacccgggttacctttacccgg

SEQ ID NO: 431698 - DNA, 625 bp, Homo sapiens
  misc_feature: GZ8MTXP02HZRVQ.39.73.G07.1.454.CMB.2.raw
  modified_base (258)..(258): a, c, t, g, unknown or other
  modified_base (291)..(291): a, c, t, g, unknown or other
  modified_base (306)..(306): a, c, t, g, unknown or other
  modified_base (308)..(308): a, c, t, g, unknown or other
  modified_base (314)..(314): a, c, t, g, unknown or other
  modified_base (319)..(319): a, c, t, g, unknown or other
  modified_base (323)..(323): a, c, t, g, unknown or other
  modified_base (359)..(359): a, c, t, g, unknown or other
  modified_base (378)..(378): a, c, t, g, unknown or other
  modified_base (392)..(392): a, c, t, g, unknown or other
  modified_base (453)..(453): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgttctattacatccactgggtncgccaggcccctggtccaagggcctgagtgggnggctcatcaacccancngcacanaactngcanagtaacttgagggcaggtccaccagtcgacccgganacgtccatccaaatccacnctacattcggaacnagtagacgtaaaatctagaacgacgacggccgttactaagttaccgtgtacggacgaaggngggtacaacggtacgttacccgagttagggggaatttaaacgggcggtacgtacttacgtttacggtagtttacggttacgttttacggacgttacggttaccggtacgggggtaacccgtaaacggggtaaacgtaaacggttccggttaacccgtaccgtttaccgtacg

SEQ ID NO: 431699 - DNA, 645 bp, Homo sapiens
  misc_feature: GZ8MTXP02HYUWJ.39.73.G07.1.454.CMB.2.raw
  modified_base (256)..(256): a, c, t, g, unknown or other
  modified_base (378)..(378): a, c, t, g, unknown or other
  modified_base (424)..(424): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatcacgtgggtncgccacggcccctggtcaagggcctggaggtggggtcggctccatccaaccccacacgtggcgaacacaaactctgacacagtacttcgaggcacgggcccaaccgagtcgaaccccggganacccgtacagtcaatacacgcctacaagtcggaacttcgaaggtanaacgttaaatcgtacgaccgaacgaccggtacccgtacttacgttacctggtacgaccggaaggaacgggcgaacgtacggttcccgaagggttcggggaaactaaggtcgacgacttaaggttccgtagtacgttcgtttttaagaacgttccgtcggttacgggggaaccctaaaggggacgttaaacgtcgggtaccctaaccggtttctttaacccg

SEQ ID NO: 431700 - DNA, 634 bp, Homo sapiens
  misc_feature: GZ8MTXP02G38GZ.39.73.G07.1.454.CMB.2.raw
  modified_base (254)..(254): a, c, t, g, unknown or other
  modified_base (298)..(298): a, c, t, g, unknown or other
  modified_base (315)..(315): a, c, t, g, unknown or other
  modified_base (351)..(351): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggagcctggggcctctctgaacgtccctgccaggcttctggatacatcttcaacgtctattacatccagtgggtncgcaggccctggtcaggctgaggtggtggctcatccaaccccanactggacacacaactcngcacagtacttgaggcaggtccacatcggaccgganaccgtcatacaatacacgcctacgatacgggaaactcgaagttaacgacgttaaaatcgtacgaccgacgaccgggtccgttaacttaacgtttacgtcggttacgggaccgtaagggacggacgtaacggtacgttacccgagggttagggggtaaactaggtccgtacggtaactttaggtttaccgtaggtttacgttacgtttaagtacgttacgttcgggtacggggtaaccgaaaggtaaccgtaaggttcggtaccgtacccgttcgtttaccccg

SEQ ID NO: 431701 - DNA, 711 bp, Homo sapiens
  misc_feature: GZ8MTXP02JFJIX.39.73.G07.1.454.CMB.2.raw
  modified_base (262)..(262): a, c, t, g, unknown or other
  modified_base (297)..(297): a, c, t, g, unknown or other
  modified_base (315)..(315): a, c, t, g, unknown or other
  modified_base (405)..(405): a, c, t, g, unknown or other
tcagtcgcactagtcacgaccggtgctcgatttagctctacgctcagggggtttctctagagaaacccctgagagctccgttcctcaccatggactggacctggaggatcgtcttcttggtggcagcagtcacaggagccccctccaggtgaaattggtgcagtctggctttgaggtgaggagccgtggggcctctctagaaacgtcccctgccaggcttctggatacattcttacaacgtctaattacatccagtgggtcncgccacggcccctggtcaagggcctggaggtgggnggctccatccaaccccancgtggaccgacaacaactcgtagcacagtaacttcgagggcaggtccaccagtccgaccgggacaccgtcactacaataccgacgcctanagtcggaaactcgaagtacgaacgttaaaactcgtaagaccgtaacgaccgggtccttactaacgtttacctgggttacgaaccgggaagggacgggtacaacgggttaacgttccgaacgggtagggggtaaataacgggtcgaccgtacgttaccggtttacggagtttaaccggttcgtttttacggaacgtttaacgggtttcccggggttaaaccggggggaacccgttaaaagggggtaaacctttaaaacggggtttcccgggttaaacccgttaccccgggttttcctttaaccccgg

SEQ ID NO: 431702 - DNA, 699 bp, Homo sapiens
  misc_feature: GZ8MTXP02G6JT6.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggaagccgtggggcctctctagaacgtcccctgccaggcttctggatacattcttacaacgtctaattacatccacgtgggtcgccgccacggcccctggtccaaggggcctggaggtgggtcggctaccgactcccgaaccccatacgtcggacgacaacaaactctgaccactagtaaccttcgagggtcacgggtaccaccgagtaccgggacccgggactaccggtacactaccaaactccgaacgtccctaagtagtacggaaaccttcgaaacggtaacgaacggtaaaactcgtacggaccgacgaccgggtaccttactaacgtttacgtacgtacggacgtaggacggacgtaagtcgttacccgaggtagggggtaaattacgggcgtacgtacgttacgttacgtacgttcgttacgtttacgtacgttacggttacgggtaaccgggggtaaccgtaaacgggtaaccgttaacggttccgggtaccgttaccggttaccgttacccg

SEQ ID NO: 431703 - DNA, 622 bp, Homo sapiens
  misc_feature: GZ8MTXP02G93RD.39.73.G07.1.454.CMB.2.raw
  modified_base (287)..(287): a, c, t, g, unknown or other
  modified_base (294)..(294): a, c, t, g, unknown or other
  modified_base (332)..(332): a, c, t, g, unknown or other
  modified_base (481)..(481): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctcccaggtgaaattggtgcagtctggctttgaggtgaggaagccgtggggcctctctgaaacgtcccctgccaggcttctggatacatcttcaacgtctattacatccacgtgggtgcgccacggcccctggtcagggcctggnggtgggnggctccatccaaccccacacgtggcacacaaactcacnccaacagtaacctttcgacggggcgtacgggtccccaaccgtagtaccggaccccggggacaccggttacccataccaaactaccacgacctacagtacggaaactcaagtacacgtaaatcgtagacgacaccgggctactattacgngtcgacgagacggcagtcgtacgacggtagggaatagcgtacgctaacgttcgagttcgtagttttacgagttaacgtcggttacggggaaccggtaaaggtaaccgtacggttacggtacccgtacgtttccgtttaccc

SEQ ID NO: 431704 - DNA, 679 bp, Homo sapiens
  misc_feature: GZ8MTXP02F8OEH.39.73.G07.1.454.CMB.2.raw
  modified_base (254)..(254): a, c, t, g, unknown or other
  modified_base (408)..(408): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggctctctgaaagtccctgccaggcttctggatacatcttcaacgtctattacatccactgggtncgcccaggcccctggtcaagggcctgagtggggtggctccatccaaccccaacactggacgacaacaaaactctgacacagtaacttcgagggcagggtccaccatcggaacccgggacaaccgtccataccaaagtaccaagccctaaacganacggtaaactaccaaagtacgaacgtaaaatctacgaaccgaacgacggtacctactatttaacgtgtacgacggaagacggacgaaagtacggttaccgaacggttagggggaaacttaagggacggtacgtaccgtaaagtttttaccggaaatttcggttaccgttttttaaggaacgttttacgtccggtttacggggggtaacccgtaaaacgggggaaaccgtaaaacgggttcggtaccgtaaccccgggtttactttacccgg

SEQ ID NO: 431705 - DNA, 579 bp, Homo sapiens
  misc_feature: GZ8MTXP02FLIIP.39.73.G07.1.454.CMB.2.raw
  modified_base (416)..(416): a, c, t, g, unknown or other
  modified_base (441)..(441): a, c, t, g, unknown or other
  modified_base (451)..(451): a, c, t, g, unknown or other
  modified_base (497)..(497): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgtctattacatccactgggtgcgccaggcccctggtcagggcctgagtgggtggctccgatccaaccccaacactggacgacacaaactctgcacagaactttcagggcagggtcccacatcggacccggacacgtccataccaatacacgacctacataggaactcagtagacgtaaanctagaccgacacgccgtatacttancgtgcgaggngacgagacgttccgagtggggaataaggtgcgtactagtttacggnttacgtgtttagaagttcgtccggtaggggaacccgtaaaaggggactaacggtagggtttaaccccgtaccgttactaccg

SEQ ID NO: 431706 - DNA, 641 bp, Homo sapiens
  misc_feature: GZ8MTXP02FHXM2.39.73.G07.1.454.CMB.2.raw
  modified_base (259)..(259): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgcccccctcccaggtgaaattggtgcagtctggctttgaggtgaggagccgtggggcctctctagaaacgtcccctgccaggcttctggatacatcttcaacgtctattacatccactgggngcgccacggccctggtcaagggcctggacggtggggtcggctccgatccaaccccaacacgtggcgacacaaactctgacacagtaacttcgaggcacgggtaccaccgagtcgacccggacaccgtcactacaaatacgacgacctacatacgaactcaagtacgaacgtaaaatcgtagaaccgaacgtaccggtccgtacttattacgtggtacgacgaaggacgggacaggtaccgttaccgaacggtaggggtaaataacggtagacgacgtacgtttacgagttacgttcgttttacgactttacgtcggttacggggaaccgtaaaagggtaccgtaaacggttccggttaccgtaaccgtttccgtttaacccg

SEQ ID NO: 431707 - DNA, 529 bp, Homo sapiens
  misc_feature: GZ8MTXP02FRJPV.39.73.G07.1.454.CMB.2.raw
  modified_base (255)..(255): a, c, t, g, unknown or other
  modified_base (308)..(308): a, c, t, g, unknown or other
  modified_base (327)..(327): a, c, t, g, unknown or other
  modified_base (493)..(493): a, c, t, g, unknown or other
  modified_base (501)..(501): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggagcctggggcctctctgaaagtcccctgccaggcttctggatacatcttcaacgtctattacatccactgggtncgccaggcccctggtcaagggcctgagtggggtggctccagtcaacccccaanacgtggcgacacaaactcngcacagaactttcagggcagggtccaccatgacccgggacaccgtccatcaaatacagcctacatggaaactcagtagacgtaaaatctgacgacacggccgtactattactgtgcgagaggcagacgttccgacgtaggggataaaggtgcgcaatttcgatcgntttgatanctggggccaagggacatggcaccgtctc

SEQ ID NO: 431708 - DNA, 603 bp, Homo sapiens
  misc_feature: GZ8MTXP02GNTVN.39.73.G07.1.454.CMB.2.raw
  modified_base (263)..(263): a, c, t, g, unknown or other
  modified_base (314)..(314): a, c, t, g, unknown or other
  modified_base (338)..(338): a, c, t, g, unknown or other
  modified_base (373)..(373): a, c, t, g, unknown or other
  modified_base (380)..(380): a, c, t, g, unknown or other
  modified_base (396)..(396): a, c, t, g, unknown or other
  modified_base (422)..(422): a, c, t, g, unknown or other
  modified_base (449)..(449): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttggaggtgaggaagccgtggggcctctctagaaacgtcccctgccaggtcttcgtggatacatcttacaacgtctattacatccagtgggtnccgcacggccctggtcagggcctggaggtggtggcctcagtaccaacccanacgtggacacacaactctgaccanacgtaacttgaggcaggtccactgcgacccggtanaccgtcntacaatacacgcctanacgtacgaacctgagtagacgtaaancgtagacgacgacggtctatattacgngtgacgagacgagagtacgttccgaggtagggaattagcggacgtaccgttagttacggtaacttcgttacgtttacgtaacgtacgtttacggacggggaacccgtaaaggggtaccctaaaggttccgtaaccggtacctttacggtacccg

SEQ ID NO: 431709 - DNA, 352 bp, Homo sapiens
  misc_feature: GZ8MTXP02JLRC4.39.73.G07.1.454.CMB.2.raw
  modified_base (269)..(269): a, c, t, g, unknown or other
  modified_base (274)..(274): a, c, t, g, unknown or other
  modified_base (282)..(282): a, c, t, g, unknown or other
  modified_base (346)..(352): a, c, t, g, unknown or other
tcagtcgcactagtcacgaccggtgctcgatttagctctacgctcagggcagggtcaccatgacccgggacacgtccatcaatacagcctacatggaactcagtagcgtaaaatctgacgacacggccgtctattactgtgcgagaggcagagttccactggggataagtgcgcatttcgatgcttttgatatcgtggggccaagggacaatggtcaccgtctcttcagcctccaccaggcccatcggtctcccctgcaccctctcagncactntgggcacngcgcctggctgctggtcaaggctacttccatagtgcgactgagccgggctggcaaggcacatgnnnnnnn

SEQ ID NO: 431710 - DNA, 783 bp, Homo sapiens
  misc_feature: GZ8MTXP02HMY72.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggacgcccctcccaggtgaaattggtgcagtctggctttgaggtgaggaagcctggggcctctctagaaacgtccctgccaggtcttctggatacattcttacaacgtctattacatccacgtggggtcgcgcccgacggcccccgtggtccgaaacgggcctggacggtggggtcgggctccgaactacccaaaccccaacgacgtcggacgaaccaacaaaactctagaccaacaacgtaactttacgacggggtacgtacgggtacccaaccgagtaccggaaccccggggacaaccggttacacgtaccaaataccgacgtacctaacagtacggtaaacctcgaagtacgaaccgttaaaatcgaacggaaccgaaccgtaccggtacccgttacgttaacgttaccgtggttacggaccgggaaggaaccgggacgtaaacggtaaccggtttaccccgaacggggttaacgggggtaaataaaacggggttcggaccgggttaaccttaacgttttacggtaaagttcgttaccgtttttaaggaacgtttacggtaccgggtacgggggttaaaacccggaaaagggtaaacccggttaaagttaccgggttaaccccgtaacccggtttccttaaccccgg

SEQ ID NO: 431711 - DNA, 714 bp, Homo sapiens
  misc_feature: GZ8MTXP02FS86G.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagccgtggggcctctctgaaacgtcccctgccaggcttctggatacatcttcaacgtcttattacatccacgtgggtcgcgccgacggcccctggtcgaagggcctggaggtcggtcggctaccgacgtaccaaccccaacacgtcgacgaacacaaactctagacacgagtacttcgaggcgtacggtcccacgtacgacggaccgggacacgtaccagtacaaactacaccgtaccttaagactacggtaacctacgtaaaggtaacgaacgttaaaacttcctacggaacccgaccggaaccggtccgttaactacgtttaacgttcggtacggaccggagaacggtaccgtaaacgggtaccgtttaacccggaacgggttaacgggggtaaataaacgggtcgtacccggtaagttacggtttacgtaaacgtttcgtttacggtttactaaccggttaacgtcgggttaacgggggaaccggttaaaggaaccgtacgttcggtaaaccgttccggtctttaccgg

SEQ ID NO: 431712 - DNA, 618 bp, Homo sapiens
  misc_feature: GZ8MTXP02GUUDM.39.73.G07.1.454.CMB.2.raw
  modified_base (194)..(194): a, c, t, g, unknown or other
  modified_base (259)..(259): a, c, t, g, unknown or other
  modified_base (310)..(310): a, c, t, g, unknown or other
  modified_base (326)..(326): a, c, t, g, unknown or other
  modified_base (421)..(421): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggagccgtgggcctntctgaaacgtcccctgccaggcttcgtaggatacattcttcaacgtctattacatccacgtggtnccgccaggcccctggtcaagggcctgaggtggtgcgtcatccaacccctanacgtgcgacacaatcngcacagactttacgaggtcagggtcccacgagtcgaccccgggacaccggttcactacaaactacgcgtaccctaagactaggaactcaggtaanacgtaaaatctagaccacgtacggcctagtacttagtcgtagcgagacgactagacgttaccgagttcgggggaattaaggcgtaacggtcttaacgttcggtattaccggttagtttacgtagttaaccgtggtacgggggtaacctaaaggggtaaccgtaaggttccggtaaccgttaccggttctttacccgg

SEQ ID NO: 431713 - DNA, 662 bp, Homo sapiens
  misc_feature: GZ8MTXP02G7S2H.39.73.G07.1.454.CMB.2.raw
  modified_base (525)..(525): a, c, t, g, unknown or other
tcagtcgcactagtcacgaccggtgctcgatttagctctacgctcaggggtttctctagagaaacccctgagagctccgttcctcaacatggactggacctggaggatcgtcttcttggtggcagcagtcacaggacgccccctcccaggtgaaattggtgcagtctggctttgaggtgaggagccgtggggcctctctagaaacgtccctgccaggcttctggatacattcttacaacgtctattacactccacgtgggtcgccgccgacggtccccgtggtaccgaacgggcctggaggtggggtcggcctaccgactaccccaaaccccaacaccgtcggaccgaaccaaccaaactctacgacacgtaagtaactttcgagggacgacggtaccccacacgtaccggacccggacaccgtaccagtaccaaactaccacgacctaacgacgtacgaaacctacgaacgtaagaacgtaaaatcgtacgaaccgacgtaccgtacgttactaacgttaccgngtacgacggagacggtagaacgtacgtccgaggtaggaatagtcgcgtacttagttacgtattcgttactttagacgttacgtacgggtacgggaaccgtaaaggaccgtaggtaccgtaccgtaccgtcttacccg

SEQ ID NO: 431714 - DNA, 648 bp, Homo sapiens
  misc_feature: GZ8MTXP02F7513.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctccaggtgaaattggtgcagtctggctttgaggtgaggaagcctggggcctctctgaaacgtcccctgccaggcttcgtggatacattcttcaacgtctattacactccagtgggtgcgccacggccctggcaagggcctggaggtgggtcggctccactccaaccccacacgtcggcgaacaaccaaactctgaccacacgtaactttcgaggacgagggtaccccaccgacgtaccggaccccgggacaccgtaccacgtaaccaaacgtaaccacgaccctaagacgtacggaacctagaacgtaacgaacgtaaatcgacgaccgacgacggtcctactacgttaacgtgtacgacggagtacggacgtaaggaccgttacgaacggtaggggtaactaaggtcgacgtacttacgtttacggatttcgttactttgacgttacgtcgggacggggtaaccgaagggtactacggttacggtacctaccggttactttcccg

SEQ ID NO: 431715 - DNA, 702 bp, Homo sapiens
  misc_feature: GZ8MTXP02JUUJ4.39.73.G07.1.454.CMB.2.raw
  modified_base (222)..(222): a, c, t, g, unknown or other
  modified_base (262)..(262): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagccgtggggcctctctgaaacgtcccctgccaggcttcnggatacatccttacaacgttctattacatccacgtgggtncgccgacggcccctggtcgaacgggcctggaggtggggtgggcctccgaatcccaaaccccaactacgcggacgacaacgaaacctcgtagccaacacgtaaactttcgacggggacgtacgggtaccccaccgtacgtcggaccccggactaccggtaccataccaaagtacccaacgtacccttaacgaacgtacggtaaacctacgaaacggttacgtaaacgtaaaactccgtacgaccgaccgaacggtcccgttacctagttaccgtgtacggacgtagacggtacgaggtacgtacccgaggtacgggggtaataaggtcggtacgtacgttacgtttacggattacggttagtttagtacgttagtacggtacgggggtaacccgtaaaaggggactacggttcggtacccgtaaccggttccctttaaccg

SEQ ID NO: 431716 - DNA, 749 bp, Homo sapiens
  misc_feature: GZ8MTXP02HOEXJ.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctcccaggtgaaattggtgcagtctggctttgaggtgaggaacgccgtggggcctctcgtagaacgtccctgccaggtcttcgtggatacattcttacaacgttctattacactcctacgtgggtgccgccgacggccccgtggtacgaacgggcctggaggtgggtcggcctaccgactacccgaacccctaacacgtcggaccgaaccgaactaaaacctcgtacgaccaaacgtacgtaacctttcggaacggggccggtaacgggtacccccaacccgtaacgtacccggggaacccccggggtaacgtacccgttaccactaaccgtaaactaccaaccgtaccctaacgacgtaaccggaactaccgaagttaacgaaacgttaaaatccgtaacgaaccgtaccggtaaccgtccgttacttacgttaaccgtcgggtacgacggtaaggacggactaacggtacgttaccggaaggtaggggtaataggtcgacgtacgtttacgttcgtaagttcgtttaacgtttagtacgttacgttacggtacggggaaaccgtaagggtaacttacgggtcgtaaccgtccgtttacttacccg

SEQ ID NO: 431717 - DNA, 706 bp, Homo sapiens
  misc_feature: GZ8MTXP02I2B9D.39.73.G07.1.454.CMB.2.raw
tcagtcgcactagtcacgaccggtgctcgatttagctctacgctcaggggtttctctagagaaacccctgagagctccgttcctcaccatggactggacctggaggatcgtcttcttggtggcagcagtcacaggacgccccctccaggtgaaattggtgcagtctggctttgaggtgaggaagccgtggggcctctctgaaacgtccctgccaggcttctggatacattcttacaacgttctattacactccacgtgggtcgccgccacggcccctggtccaacggggcctggagggtggggtcgggcctccgatacccaaccccaacacgtcggaccgaacaaccaaaactctagaccacacgtaaacctttcgacgggacacgggtaccaccgagtaccggaccccgggtaacaccggttacccacgtaccaaactaccgaacgtaccctaacacgtacgggaaaccttacgaaaggttaacgaaaccgttaaaaagtccgttaaacggaaccgaaaccgaccgggtacccttacttaactttaacgtcgttacggaccggagtaccggacgtaaacggtaccgtttaccgaacgggttaggggtaaactaacggttcgacgtactagtttacgactttgtacttttagattacgtcgtacggggtaacgaaagggactaaggcgtacctaccgtcttacccg

SEQ ID NO: 431718 - DNA, 707 bp, Homo sapiens
  misc_feature: GZ8MTXP02HG4YE.39.73.G07.1.454.CMB.2.raw
  modified_base (260)..(260): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctagaaacgtccctgccaggcttctggatacatcttacaacgtctattacactccacgtgggtnccgccgacggcccctggtacgaacgggcctggacggtggggcggtcctaccgacgtaccccaaaccccaacacgtcggaccgacaacaaactctagaccaacacgtaaccttacgacggggactacgggtaccaccgacgtacggaaccccgggactaccggtccactaccgaaactaccgacgaccctaacacgtacggaaactacgaagtacgtaacgtaaaatccgtaacgaaccgaaccgtaacccggtccgttacttaactttacgtcggttacggacggtaaggacgggactaacggtaccggttacccgaagggttacggggtaattaaacggttcggacggtacttaaacggtttcgagtttcgttacgtttagacgttacgttacgggacgggtaaccgaaggtacgtacggtttacggaccctacggtttcttaccg

SEQ ID NO: 431719 - DNA, 660 bp, Homo sapiens
  misc_feature: GZ8MTXP02FTLFX.39.73.G07.1.454.CMB.2.raw
  modified_base (258)..(258): a, c, t, g, unknown or other
  modified_base (435)..(435): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacattcttcaacgtctattacatccactgggtncgccgaggcccctggacagggcctggaggtggtcggctccgataccaaccccaacacgtcgcaacacgaaactctgacacgaacgtaactttggaaggcgtacgggtaccccacgacgtacggaaccccggacaccgtcactacaaactacgactacctaacaagtacgggtaaacncgaagtacgaacgtaaatcgtagaccgacgacgccgtactacgttacagtgacggagacggacgtaacgtacgtaccgtacggtaggggaacgttaacggcgacgtagtacgtttacgagttacgtttacgtttagggtaacttacggtacggtacgggggtaaccgtaaacggggttaacctaacgggttaccggtaaccggtaccgtttacgtttaaccccgg

SEQ ID NO: 431720 - DNA, 408 bp, Homo sapiens
  misc_feature: GZ8MTXP02GHAY2.39.73.G07.1.454.CMB.2.raw
  modified_base (382)..(382): a, c, t, g, unknown or other
  modified_base (400)..(408): a, c, t, g, unknown or other
tcagtcgcactagtcacgaccggtgctcgatttagctctacgctcagggtcaccatgacccgggacacgtccatcaatacagcctacatggaactcagtagcgtaaaatctgacgacacggccgtctattactgtgcgagaggcagagttccacgtggggataagtgcgctatttcgattgtctttttgatatcgtggggccaagggacaatggtcaccgtctctcagcctccaaccgaaggcccattccggtccttcccccgtggccaccctccctccaaagacgccacctcgtgggggaccacgaacgccgggccccgtgggaccttcgccgtggtacaaacggtactaccgttccactaggtcgcgaacgtgaggcggntcggcaaggcgacatagnnnnnnnnn

SEQ ID NO: 431721 - DNA, 610 bp, Homo sapiens
  misc_feature: GZ8MTXP02GK2EY.39.73.G07.1.454.CMB.2.raw
  modified_base (260)..(260): a, c, t, g, unknown or other
  modified_base (335)..(335): a, c, t, g, unknown or other
  modified_base (380)..(380): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggagcctggggcctctctgaaacgtcccctgccaggcttctggatacattcttcaacgtctaattacatccacgtgggtcncgccaggcccctggtcaagggcctgacgtgggtggctccagtcaaccccgaacaccgtgacgacacaaactctancgacagaactttcgaggtccagggtccaccgcgtagacccggganaccgtcatcaatacagcctacatcgaaactacagtagacgtaaatactagaaccgacgaccgacccgtacgtactttaaccgtgtagaccggaaggaggaccgaagacgttaccgaaacgttggggaattaaggcgacgtctaaagtttcggaattggttactttacgttagttacgtacgttacgggtaacgaacggaacgtaagtacgtacgtaaccgtcgtttaccg

SEQ ID NO: 431722 - DNA, 581 bp, Homo sapiens
  misc_feature: GZ8MTXP02FMQSX.39.73.G07.1.454.CMB.2.raw
  modified_base (257)..(257): a, c, t, g, unknown or other
  modified_base (287)..(287): a, c, t, g, unknown or other
  modified_base (304)..(304): a, c, t, g, unknown or other
  modified_base (370)..(370): a, c, t, g, unknown or other
  modified_base (512)..(512): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagcctggggcctctctgaaacgtcccctgccaggcttctggatacatcttcaacgtctattacatccactgggtncgcacggcccctggtcagggcctgagtggnggctcatcaaccccaancgtggacgacacaaactctgcacagtaactttcgagggcagggtacccaccagtacgacccggganaccgtaccagtacaaataccgacgaccctaacattacggaaactcgaagtacgacgtaaaatcgtagaaccgacgacgggctactattactgtagacgagagacagacgttcacgtggggattagagtccgatagtttacgngtacgttatttacggattacgtcggtacgggaacgtaagggactaagtggtaccaccgttcttaacccg

SEQ ID NO: 431723 - DNA, 610 bp, Homo sapiens
  misc_feature: GZ8MTXP02FK977.39.73.G07.1.454.CMB.2.raw
  modified_base (311)..(311): a, c, t, g, unknown or other
tcagtcgcactagtcacgaccggtgctcgatttagctctacgctcaggggtttctctagagaaacccctgagagctccgttcctcaccatggactggacctggaggatcgtcttcttggtggcagcagtcacaggagccccctcccaggtgaaattggtgcagtctggctttgaggtgaggaagccgtggggcctctctgaaacgtcccctgccaggcttctggatacatcttcaacgtctattacatccactgggtgcgccaggcccctggtccaagggcctggagtggggtggctccatccaaccccanactggacgaacacaaactctagcacagactttcgagggcaggtccaccatcgacccgggacacgtccatccgaaatacacgcctaacatacgactcgaagtacgaacgtaaaatcgtagaccgtacgacgtccgtacttacgttacgtgtcgacgaggacgacgagtacgttaccgacggtagggggtaactaaggtggtaccgacgttaacgtttccggatttcgtacgtttttacgagtttacgtcggttaggggaaccgtaacgggaataacgtcgggtactacccggttctaccg

SEQ ID NO: 431724 - DNA, 589 bp, Homo sapiens
  misc_feature: GZ8MTXP02H9911.39.73.G07.1.454.CMB.2.raw
  modified_base (197)..(197): a, c, t, g, unknown or other
  modified_base (254)..(254): a, c, t, g, unknown or other
  modified_base (288)..(288): a, c, t, g, unknown or other
  modified_base (404)..(404): a, c, t, g, unknown or other
tcagtcgcactagtcacgaccggtgctcgattttagctctacgctcaggggtttctctagagaaaccccctgagagctccgttcctcaccatggactggacctggaggatcgtcttcttggtggcagcagtcacaggagccccctcccaggtgaaattggtgcagtctggctttgaggtgaggaagcctggggcctntctgaaagtccctgccaggcttctggatacatcttcaacgtctatacatcatgggtncgccaggcccctggtcaagggcctgacggtgggnggctcgatccaacccaacacgtgacgacaacaaactctgacacagaactttcgaggtacagggtaccccacctagtcgacccggggataccggaccatacaaataccacgacctanaatgaacctacagtacgacgtaaaaactcgtacgacgacgacggccgtactattaacgtgtagacgtagtaggtagacgttcgaacgtgggaagtagttacgcgtacgtatttacgattgtcttttagacttagacggttcgggaacgaacgggactaagtacgtaccgtaccggtcttctaccg

SEQ ID NO: 431725 - DNA, 612 bp, Homo sapiens
  misc_feature: GZ8MTXP01CWMPP.52.3.A03.1.454.CMB.2.raw
  modified_base (517)..(517): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcggggggagcgtggtccagcctgggaggtccctgagactttcctgtgaggcctctggattcaggtttagtattttgccatgcactgggtccgccaggctccaggcaaggggctgggagtggggtggcggttgtgtaccaaatagtgggaactaagtagattattatgcagaacttccggtgaggggtcccgttcaccgtctcagagacaattcccagatatgtgtatctgcaaatgaaactaagtttggggggtccttagaaacgacacgggtcttggtttattacgtggtagacgtaaaagggtcggggaaaggtanaaggtacaaccgtaaagttgggttaaacccaacttaaaccccgttaattttttaccgtaacttagttacggacggttaacgttcggggtaaccgg

SEQ ID NO: 431726 - DNA, 703 bp, Homo sapiens
  misc_feature: GZ8MTXP01DANGA.52.3.A03.1.454.CMB.2.raw
  modified_base (387)..(387): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaacgtggtgggaggtcgggggggagcgtggtccagccgtgggacgtccctgagtactttccgtgtgacggtcctcgtggtattcgtaggtttagttatttttgcctatgctacgtgggtccgccgaggcctccgaggacgaaggggctgggaggtgggtggcggttgtgtacaaagtagtggaactaatagtatattangacagaacgtccggtggacggggtccgttacaccgtcgtaccgagacgactaactcccaagtaatgttgtagttaactctagaactaaagtacgtaaacgttagttttcggggggtacccttaaggaaacgtaccgtaacgggttcctttaggttttaattacgtggtaacgtaacggtaaaaggtcggggaaagtaacttacggaacaaaccgtaaagttacggttaaacccttaaaccgttaaaccccggtttttaatttttaaccgtaactttaacggtacggttaacggttcgttaacgggttaacccgggg

SEQ ID NO: 431727 - DNA, 748 bp, Homo sapiens
  misc_feature: GZ8MTXP01BV0J4.52.3.A03.1.454.CMB.2.raw
  modified_base (314)..(314): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaacgtgggtgggaggtcggggggaggcgtggtccaggccgtgggacgtccctgacgtactttccgtgtgacggtcctgtggtatttcgtaggttttagttatttttgcctatgcacgtgggtcccnccgaggctccgaggacgaagggggctgggaggtgggtggcggttgtcgtaccaaagtgtgggaactaatagtatattatgcagtaacctccgtgggacggggtccgttccaccgtctaccgagacgactaatcccaagaatagttgttagtactctagacctaaaagtacgtaaaccgttaaattttcggggggggtacccttagggggaaactaacccggtaacgggtcctttaaggttttaactttaaccgtggttaacggtaaaccgtaaaaaggggttcgggggaaaagtacgttaacggaacccttaaaccgtaaaaggttttccgggttaaaaccttaaaacccgttaaaaccccggttttttaattttttaacctaaaccgttttagtacgggttaccgggtttcgttaacggggttaaccccgggg

SEQ ID NO: 431728 - DNA, 702 bp, Homo sapiens
  misc_feature: GZ8MTXP01ER3Q3.52.3.A03.1.454.CMB.2.raw
  modified_base (246)..(246): a, c, t, g, unknown or other
  modified_base (309)..(309): a, c, t, g, unknown or other
  modified_base (409)..(409): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaacgtggtggaggtcggggggagcgtggtccagccgtgggacgtccctgagtacttcngtgaggcctgtggtattcgtaggttttagttattttcggccctagtcgctacgtgggtacccnccgagggtcctaccgaggacgaaagggggtctgggggtaggtggggtggtcggtttgtacgttaccaaagttagtgggaactaaagtagtaacttattangcaaggtaaccgtcggtgggacggggtcccgttaccaccgtctaccgagtacgactaacttcccgaagtaattagttgtttagtactcgtagaacaaatgtaaactaagtttcggggtacgtagtaacgacgtacggtcttagtttactacgtagtagtaaaccggaaaaggttcggggaaagtacgttaacgaccttaaaccgttaagttaacggttaacccttaaacgttaaacccctttttaattttaccgaactttacggtaggttaccgtcgtttccggggtaaccgg

SEQ ID NO: 431729 - DNA, 808 bp, Homo sapiens
  misc_feature: GZ8MTXP01EVP2I.52.3.A03.1.454.CMB.2.raw
  modified_base (245)..(245): a, c, t, g, unknown or other
  modified_base (301)..(301): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcggggggagcgtggtccagccgtgggacgtccctgagtactttcngtgacggcctctggtattcgtaggtttagttattttgcctatgcacgtgggtcccnccgagcctcgaggcgaaggggctgggagtggggtggtcggttgtcgtaccgaaagttgtacgggggtaattaaagtagtaacttaatttaagtcggacctaaggtaaaccgtcccggttggggaaccgggggttccccgttaccgtaacccgttacccgtaccgaaggtaacgtaaacctaaacgttaccccaaaggtaaactagttaggtttaggtacttacgtaggtaaccaaaagttaggtaaaacgttaaacggttttacggggggtacccgtttaagggaaacgtaccggtaacccggtcgttttaacggttttaatttaaccggttaggtaacggtaaaccggttaaaaagggttccggggaaaacgggtaagttaaacgggtacccttaaacccgtaaagtttaaccgggttaaaccgttaaacccttaaacccggttttaactttttaacgtaacgtttaaacggtcggttaaccggttccgttaacgggtaacccggg

SEQ ID NO: 431730 - DNA, 749 bp, Homo sapiens
  misc_feature: GZ8MTXP01BW9U3.52.3.A03.1.454.CMB.2.raw
  modified_base (248)..(248): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactgggtggaggtcggggggagcgtggtccagccgtgggacgtccctgacgtactttccngtgaggcctgtgggatttcgaggttttagtatttttgcctatcgcacgttcgggtccgccaggcctccgaggcgaagggggtctgggaggtggggtggtcggtttgtcgtacaaagtagtagggtaactaagtagtacttaacttagtcgtactaacggtaacccgttcccgggtggggtaccgggggtcccggtttacccgacccgggttaccttacccggaaaggtaaacggtaacctaaacgtttacccccgaaaggtaaactttaacgttacggtttaggtaactttacgttacggaacttaaaagtacggtaaaacgttaacggtttcggggggtaaccttaggaaacgtacgtacgtcgttagtttattacgtgtagaacgtaaagggtcgggaaagtattacggacaaaccgtaaagttcggaaaccttaaccgttaacccgtttaatttttaccaacttagtcggttaccggttcgttaacgggttaaccggg

SEQ ID NO: 431731 - DNA, 653 bp, Homo sapiens
  misc_feature: GZ8MTXP01DW7GM.52.3.A03.1.454.CMB.2.raw
  modified_base (302)..(302): a, c, t, g, unknown or other
  modified_base (387)..(387): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcggggggagcgtggtccagccgtgggagtccctgagtactttcgtgtgaggccctgtggatttcgtaggtttagttattttgcctatgcacgtggggtcccncgaggcctaccgaggacgaaggggtctgggaggtgggtggtcggttagtgtaccaaagtagtgggaactaagtagtattattagngacagtacgtcggtgggacgggtccgttacaccgtctacgagacactaactaccaagtaattagttagttagtatactagaactaaagtagtaaacgttacggtttacggggtacgtagaacgtacgtacgtatttacgtttattacgtgtaagtaacgtaaagggtagggaaatcgttacgaaccttaaacgtaacgttacgttaaacttaaccgttaaccttttaattttacaacgttagtacgttacggttcgttcggtaacg

SEQ ID NO: 431732 - DNA, 709 bp, Homo sapiens
  misc_feature: GZ8MTXP01A4KKL.52.3.A03.1.454.CMB.2.raw
  modified_base (246)..(246): a, c, t, g, unknown or other
  modified_base (288)..(288): a, c, t, g, unknown or other
  modified_base (303)..(303): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaacgtggtggaggtcggggggagcgtggtccagccgtgggagtccctgagactttccngtgacggcctgtggtattcgtaggtttagttattttgcctangcacgtcgggtcccnccgaggcctaccgaggacgaagggggctgggaggtgggtggggtccggtttgtacgtaacccaaagttaggtagggtaacttaaataggtaacttagttaatggaccagtaacccgttccggtgggacgggggtcccgttcgacccgtcgtacccgaagacgaacctaacttacccgaagtaactagttgttagtactcgtagactaaagttacgaaacttaaggtttcgggggactaggaaacgacgtaacggtcttagtttatttacgtggttagaacgtaaaagggtcggggaaagagttaacggaccttaaccgtaaagttacggttaacccttaaaccgttaacccgttttaatttttaccctaagttacgtacggttacggttcgttcgggtaacccggg

SEQ ID NO: 431733 - DNA, 717 bp, Homo sapiens
  misc_feature: GZ8MTXP01EX66Y.52.3.A03.1.454.CMB.2.raw
  modified_base (248)..(248): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaacgtggtggaggtcggggggagcgtggtccaggccgtgggacgtccctgagtactttccngtgaggcctcgtggtattcgtaggtttagtatttttgcctatcgcacgtcgggtcccgcaggcctccgaggcgaaggggctggggaggtggggtggtcgggttgtcgtaccgtaaagtgtagggactaaagtagattaattatagcaggtaaccgttccggtggacggggtcccggttaccaccggtccgacgtagacgtactaaacttcccgaagtaattagttgttacgtagttacgtagaactaaaagttacggtaaacttaaggttttcgggggaccttaaggaaacgtacgtacggtccttaggttttaactaacgttgtagaaccgtaaaagggtcggggaaaggtacgttacgacgttaaccgtaaaggttcggttaaaccccttaaacgttaccccggttttaattttttacgaaaccgtttacgttacgggttaccgggttaacgttcgggtaacccggg

SEQ ID NO: 431734 - DNA, 672 bp, Homo sapiens
  misc_feature: GZ8MTXP01DI9J1.52.3.A03.1.454.CMB.2.raw
  modified_base (309)..(309): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaatggtggaggtcggggggaggcgtggtccagccgtgggagtccctgagtactttcctgtgacggtcctctggtattcgtaggttttagttatttttcgcctatcgctacgtcgggtcccnccgaggcctccgaggccgaaggggctggaggtgggtggtcggttgtgtaccaaagtacgtagggaactaatagtaattatatgacagtaactcgtggacggggtcccgttcgaccgtctaccagacacctaacttacccaagtaatagttgttagtactcgtagactaaattgaaacttaagtttcgggggtacctagggaaacacgtaaccggtctttaggtttattacgttgtaacgtacgtaaaaggtcggggaaagtattaacgtcaaaccgtaaagtttacggttaaaccttaaaccgttaacccgttttaattttacctaacttgtacggttaaccggttcgttcgggttaacccgg

SEQ ID NO: 431735 - DNA, 798 bp, Homo sapiens
  misc_feature: GZ8MTXP01AFCGR.52.3.A03.1.454.CMB.2.raw
  modified_base (324)..(324): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaaggaggtgtccagtgtcagggagcaacgtgggtgggaggtcgggggggagcggtggtccaggccgtggggacggtccctggacgtacctttccgtgtggacggtccttcgtggtattcgtaggttttagttattttcgctagtgctacgtcgggtccnccgaggtcctcgaggcgaaggggcgtgggtaggtgggggtggtcgggttgtacgtacctaaagttcggtaaggggtaacttaaagtaggtaatttagttagtagacctaggtaacccgttaccggggtgggaccgggggtcccggttccaacccggtccgtaccgaagaacgtaaccctaacttacccgaaagtaaattagttagtttaggtacttacgtacggtaaactaaagttacgtaaactttaacgggtttcgggggttaacccgtaaggtaaccgtaacggttaccggttcgtttaaggttttacttacggttaggtaggttaaaccgaaaaggggtcggggtaaaaggtgttaaaccggaccttaaacccgtaaggttttaacgaaacccgttaaccgtttaaacccgtttttaatttaacggtaacttagttcgggttaaccggttcggttaacgggttaaccggg

SEQ ID NO: 431736 - DNA, 672 bp, Homo sapiens
  misc_feature: GZ8MTXP01BW2BX.52.3.A03.1.454.CMB.2.raw
  modified_base (249)..(249): a, c, t, g, unknown or other
  modified_base (307)..(307): a, c, t, g, unknown or other
  modified_base (380)..(380): a, c, t, g, unknown or other
  modified_base (443)..(443): a, c, t, g, unknown or other
tcagcgcagtacgacacgaccggtgctcgatttagagagcgtcacaggggggggagaggagcccagcactagaagtcggcggtgtctccattcggtgatcagcactgaacacagaggactcaccatggagttcgggctgagttgggtcttcctgttgcttcttttaagaggtgtccagtgtcaggagcaacgtgggtgggaggtcgggggggagcgtggtccagccgtgggacgtcctgagtactttcngtgacgtcctgtggtatttcgtaggtttattattttcgcctatcgctacgtcgggccncgaggcctcgaggcgaggggctgggagtgggtggtcggttgtacgtacaagtgtaggaactaatagtatatangacagtaccgtccggtgggaccggggtccgttacaccgtctacgagacactactcaagtactnttgttatatctagaactaaatacgtaaacgttaaggtttcgggggtactaaggaacgtacggtacggtctttagtttaacttacgtagtacgtaaacgtaaagggtacgggaaagtacgttaacggtaccaaacgttaaaggttaccttaaacccgttaacctttaaaccccgtttttaattttacccgaagtttacggtaggttaccggttcgttcgggtaacccggg

SEQ ID NO: 431737 - DNA, 661 bp, Homo sapiens
  misc_feature: GZ8MTXP01BZV22.52.3.A03.1.454.CMB.2.raw
  modified_base (249)..(249): a, c, t, g, unknown or other
  modified_base (259)..(259): a, c, t, g, unknown or other
  modified_base (305)..(305): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaacgtggtggaggtcggggggaggcgtggtccagccgtgggaggtccctgagtactttccngtgaggcctntggattcgtaggttttagttatttttgcctatgcacgtcgggtccnccgaggcctccgaggcgaaggggctgggaggtgggggtggtcggttgtgtaccaaagtgtagggtaactaagtagtacttattatgacagtacctccggtgggacggggtccgttcacccgtctaccgagacgtactaactccaagaacttagtgttagtatctagaacaaagtagaaactagtttcggggggtaccttaaggaacgtaccgtacggtctttagtttattacgtgtagtaaccgtaaaaggtcgggaaagtagttacgacttaaccgtaaagttcggttaaccttaaacgttacccgtttaatttttaccgaacgttagtacggttacggtcgttcgggtaaccgg

SEQ ID NO: 431738 - DNA, 664 bp, Homo sapiens
  misc_feature: GZ8MTXP01BYMTL.52.3.A03.1.454.CMB.2.raw
  modified_base (245)..(245): a, c, t, g, unknown or other
  modified_base (255)..(255): a, c, t, g, unknown or other
  modified_base (298)..(298): a, c, t, g, unknown or other
  modified_base (441)..(441): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcggggggagcgtggtccagcctgggaggtccctgagtactttccngtgaggcctntggattcgaggttttagtatttttgcctatgcacgtgggtccnccgaggcctccgaggcaagggggctgggagtggggtggtcggttgtgtaccaaatgtagggactaagtagtatattatgcaggaactccggtggacggggtcccggttacacccgtctcccgagacactattcccaagaactntgttagtatctagacaaatagtaaactaagttttcgggggtccttaggaacgtaccgtacggtcttggtttaattaccgtggtagaacgtaaaagggtcggggaaaggtattaacggacaaaccgtaaagttacgggttaaaccttaaaccgttaaaccccggttttaattttttacccgtaaacttacgttacggttaccgggttcgttcgggttaaccggg

SEQ ID NO: 431739 - DNA, 802 bp, Homo sapiens
  misc_feature: GZ8MTXP01APCSQ.52.3.A03.1.454.CMB.2.raw
  modified_base (255)..(255): a, c, t, g, unknown or other
  modified_base (282)..(282): a, c, t, g, unknown or other
  modified_base (298)..(298): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaacgtggtggaggtcggggggagcgtggtccagccgtgggagtccctgagtcttctgtgaggtcctntggtattcgaggtttatatttgcctancgctacgtcgggtccncgaggcctcgaggcgaaggggcgtagggacggtgggggtcggtcgggtttagtacggtaaccgtaaagtagtacggggtaaacttaaagtaagttaacgtttaagttacgttacggaacccgtaacggtaaacccggttcccggggttaaggggtacccggggggtacccccgggtttacccgtaacccccgggttaccgttaccccgggaaaggaacccgtaaacccgttaaaccgtttaacccccgaaaggttaaaccgttaacgtttagggtttaactacgttaccgtaagtaaccgttaaaagtacggttaaaacgttaacggtttacgggggtacccgttaaaggaacggtaaccgtacggtctttaggtttattacgtgtacgaaagtaacggtggaagagttacgaccttacgtaaacgttacgttaacccttaacgttaaccccgttttaattttcgtaacgtcgttacggttacggttcgttaacgggtaaccgg

SEQ ID NO: 431740 - DNA, 562 bp, Homo sapiens
  misc_feature: GZ8MTXP02GJSAK.52.3.A03.1.454.CMB.2.raw
  modified_base (239)..(239): a, c, t, g, unknown or other
tcagcgcagtacgacacgaccggtgctcgatttagagagcgtcacagggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggagtcgggggagcgtggtccagcctgggagtccctgagactttccngtgaggcctctggattcaggtttagtatttttgcctatgcactgggtccgccaggctccaggcaaggggctggagtggggtggcggttgtgtaccaaatagtggggactaaatagatattatgcagactccgtggacggggccggttcaccgtctccagagacaattcccagaatatgttgtatctgacaaatgaaactagtttgggtcctagaagacgacggcttgtttattactgtagacaaaaggtcgggaaagatagacaacaattacgaacaaactaacccgttaatttttcaacttagtagtacggtctaggtaccg

SEQ ID NO: 431741 - DNA, 643 bp, Homo sapiens
  misc_feature: GZ8MTXP02GKII7.52.3.A03.1.454.CMB.2.raw
  modified_base (241)..(241): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcgggggaggcgtggtccagcctgggagtccctgagctttcngtgaggcctctggattcgaggtttagttattttgcctatgcacgtggtcccgcaggctccgaggcaaggggctggaggtggggtggcggttgtcgtaccaaaagtgtaggggaactaaagtagattaattagtgcagaccgttccggtggacgggggtccgttcgacccgtctaccaggacgaacaacttcccaagtaatattgttagtagtctagactaaaagtcgtaaactaagtttcgggtacctaggaaacgtacgtacggtcttaggtttaattacgttagtagaacgtaaaaggtcggggaaagtagtagactaaccgtaaagttacggtaaacctaaccgttaacccgtttaatttttacccaatttacgtacggtaacgttcgtacggtaccgg

SEQ ID NO: 431742 - DNA, 628 bp, Homo sapiens
  misc_feature: GZ8MTXP02GPTSK.52.3.A03.1.454.CMB.2.raw
  modified_base (309)..(309): a, c, t, g, unknown or other
  modified_base (414)..(414): a, c, t, g, unknown or other
  modified_base (445)..(445): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactgggtggaggtcggggggaggcgtggtccagccgtggggacgtccctgagtactttccgtgtgaggtcctcgtggattcgtaggttttagtatttttgcctattgctacgtggggtccnccgaggcctccgaggcaagggggctgggaggtggggtggtcggttggtgtaccaaatgtgggactaatagatagtatgacagacgttcgtggacgggcgttaccnccgtctcgagagacaacttcccaagtaactntgttagtatctagactaaatggaaaactagtttgggtacctagaacgtacgtacggtctttagtttattataggtgaaactaaaagggtgggaaagtactagaccctaaagtacgttacggaacctaaacgtaacccgtttaagtttttaaccacgttagtacgacggttcgtacgggtaccg

SEQ ID NO: 431743 - DNA, 685 bp, Homo sapiens
  misc_feature: GZ8MTXP02IFLRT.52.3.A03.1.454.CMB.2.raw
  modified_base (244)..(244): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaacgtggtggaggtcggggggagcgtggtccagccgtgggagtccctgagtactttcngtgaggcctctggattcgtaggtttagtatttttgccattgcacgtcgggtcccgctaggctccgaggccgaaggggctgggaggtggggtggtcggttgtgtaccgaaaagtgtaggggaactaaagtagacttattaatgacagactcggtgacggggtccgttcaccgtcctcgaagtacgactaacttacccaagtaattatgtttagtatcgtacgaactaaagtacgaaaacttaaggttttcgggtacccttagaaacggtaaccgtacggggttccttaggttttaaattaaccgttggtaagtaaccgtaaaagggtaccggggaaaagtaacgttaggacctaaaccgtaaagtttaacggtaacctaaaacccgtaaccgttttaactttttactaaccttagtacgtaaccggtcttacgggtaaccgg

SEQ ID NO: 431744 - DNA, 648 bp, Homo sapiens
  misc_feature: GZ8MTXP02IYBYA.52.3.A03.1.454.CMB.2.raw
  modified_base (240)..(240): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggagtcggggggagcgtggtccagcctgggagtccctgagactttcngtgaggcctctggattcaggtttagtatttttgcctatgcactggtccgccaggcctccaggccaaggggctggagtggggtggtcggttgtgtccaaatgtgggactaatagatattatgcagactccggtggacggggccgttcgaccgtctccgagacgactaattcccagaatatgttagtatctagactaaagtgaaactaaagttttcggggacccttaggaaacgacgaaccggtacttaggttttaattactgttagtaaaccgtaaaaagggttccgggaaaaggtagttaacgggacctaaaccgttaaagtttacgggaaaactaaaacccgttaaaccccgtttaatttttttacccaaattaccgtagtaaccggtttcgtacgggttaacccgg

SEQ ID NO: 431745 - DNA, 717 bp, Homo sapiens
  misc_feature: GZ8MTXP02HUTHJ.52.3.A03.1.454.CMB.2.raw
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaactgggtggaggtcgggggggaggcgtggtccagccgtggggacggtccctgagtactttccgtggtgaggcctgtggattctaggtttagtatttttgccatgcacgtcggtccgccaggctccgaggccgaaggggctggaggtggggtggtcgggttgttacgtaccgtaaaattagtaggggtaactaaataggtaactaagtttaactaggactaaggtacccgttcccgggtaggggacgggggtccccgtttacgaacccccgttccgtacccgaagtaaacggacctaaacgtttccccaaagtaatagtttagttagtacgttactagacaaaagtcgaaaattacgtttaggggtaccttaggaaacgtacgtacggtcttaggttttaatacgttaggtacaaacgtaaaaggtacggggtaaaaggtactaacggactaacctaaagttacggtaaactaaaccgttaaacctttaactttttacaagttactacgtaccggtgtttacggaaccg

SEQ ID NO: 431746 - DNA, 587 bp, Homo sapiens
  misc_feature: GZ8MTXP02FJPU0.52.3.A03.1.454.CMB.2.raw
  modified_base (243)..(243): a, c, t, g, unknown or other
  modified_base (385)..(385): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggagtcggggggaggcgtggtccagcctgggaggtccctgagactttccngtgaggcctctggattcaggtttagtatttttgcctatgcactgggtccgcaggctccaggcaaggggctggagtgggtggcggttgtgtaccaaatatgggaactaatagatattatagcagctccgtgagggggccgttnacccgtctccagagactaacttcccaagaatatgttagatctgacaaatgaaactaagtttgggacctagaagacacggtcttagtttatacgtgtagtaacgtaaaaggtcgggaaaggatacgacaaccgtaaatttacggaaactaaccgtaaacccttaattttttacccaaattactagacggttctagggtaccgg

SEQ ID NO: 431747 - DNA, 735 bp, Homo sapiens
  misc_feature: GZ8MTXP02F1QZ8.52.3.A03.1.454.CMB.2.raw
  modified_base (294)..(294): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggagtcgggggagcgtggtccagcctgggagtccctgagtactttcctgtgaggcctcgtggattcgaggtttagtatttttgcctatgcacgtggtccnccaggcctccgaggcgaaggggctggaggtggggtggtcggttgtcgtaccaaagtagtggggaacttaaagtagtattaattagtagacagtaccgttccgggtgggacgggggtcccggttaccaccccgttcctacccgaaggaacgtaaaccgtaaactttacccccgaaagtaaaacttagtttaggtttacgtacttaccgtaggtaacctaaaaagtacgtaaaaccgttaaaggtttttacgggggttacccttaagggaaaaccggtaaccgtaacggttaccgtttaggttttaaactttaccgttaggttagaaaccgtaaaaagggtcggggtaaaacgtagttaacgacgtaaaccgttaagttacggtaaaaccaaccgttaaacccgtttaagtttttcaacttagtacgtacggtctaggtaccg

SEQ ID NO: 431748 - DNA, 643 bp, Homo sapiens
  misc_feature: GZ8MTXP02GX1SW.52.3.A03.1.454.CMB.2.raw
  modified_base (245)..(245): a, c, t, g, unknown or other
  modified_base (498)..(498): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaacgtggtggaggtcggggggaggcgtggtccagccgtgggagtccctgagactttcngtgaggcctcgtggattcgaggtttagtatttttgcctatgcacgtcgggtccgccaggcctccgaggccgaaggggctggaggtgggtggtcggttgtgtccaaaagttgtggggaactaaagtagagttaattatgacagtaccttccggtggacggggtcccggttcacccgtctaccgagacgaaacctaacttcccgaagaaattatgtttagtatctgacaaatgaaactagtttcgggactagaanacgtaggcttgtttacttagtgtagaacgtaaaaggtcgggaaaaggtactaggaccaaactaaagttcggaaaacctaaaccgttaaacccgttaattttttacgaactttacgtacggtaaccggttaggtacggtaacccgg

SEQ ID NO: 431749 - DNA, 640 bp, Homo sapiens
  misc_feature: GZ8MTXP02F023C.52.3.A03.1.454.CMB.2.raw
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactgggtggaggtcggggggagcggtggtccagccgtgggaggtccctgagtactttcctgtgaggcctctggattcgaggttttagttatttttgcctatgcacgtgggtccgccaggcctccgaggcgaaggggctggaggtggggtggtcgggttgtgtaccaaagtagtgggaactaaagtagattatatgcagactcgtggacggggccgttcaccgtctcgagagactatacccagtaatattgttgtatctagactaaagtagaaacttagtttggggtacctaggaaacgtaccgtacggttacctttaggtttattacgttaggtacgtaaaccgtaaaaggttacggggaaacgtataaggcctaaaccgtaagttacggtaaaccctaacgttaaccgtttaattttaccgatacgttaggtaccgttgtacggttaccgg

SEQ ID NO: 431750 - DNA, 677 bp, Homo sapiens
  misc_feature: GZ8MTXP02F6J3N.52.3.A03.1.454.CMB.2.raw
  modified_base (300)..(300): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcgggggagcgtggtccagccgtgggacggtccctgagtactttccgtgtgaggcctcgtggattcgaggttttagtatttttgcctatgcacgtgggtccncaggctccgaggcaaggggctggaggtggggtggtcggttgtacgtaccaaaagttacgtagggaactaaagtagattattatgacaggaccttccggtgggacgggggtcccggttacgacccgttctacccgaaggtacgaaacctaaacgtttccccaaaggtaaattagttggtttagtacttcgtagactaaaagtgtaaaactagtttaggggtaccttaggaacgtacgacggtcttaggtttatacgtgtacgaacgtaaaagggtgggaaaacgtagtagacctaaaccgtaagttacggtaaacctaaccgttaaacccgtttaagtttttacaacgttagtcggtaacggtcgtacgggttaaccg

SEQ ID NO: 431751 - DNA, 766 bp, Homo sapiens
  misc_feature: GZ8MTXP02GKP7E.52.3.A03.1.454.CMB.2.raw
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcggggggaggcgtggtccagccgtggggaggtccctgagtactttcctgtgaggcctcgtggattcaggtttatatttttgcctatgcacgtcggtccgccaggcctccgaggcgaaggggctggagtggggtggcggttgtgtaccaaagttagtggggtaactaaagtagtaattattatgacagtaccttccgggtgggacgggggtcccggttacgtaccccgtctcccgaagaacgacctaaactttaccccaagtaaacttattgttagtattctagtactaaaagttacgtaaaacgtaagttttacggggttacccgttaaggtaaacggaaccggtaacggtaccgtttagggtttttaaatttaaccgttaggttaacggtaaacccgtaaaaaggggttaccgggggaaaacgggtaagttacgggaacctaaaacccgtaaaggtttaaccggtaaaaccctaaaccgtttaaaaccccggttttaaacgttttttttaccaaacgtttaacgttacgggtaaaccggtttcggttacggggtttaacccgggg

SEQ ID NO: 431752 - DNA, 642 bp, Homo sapiens
  misc_feature: GZ8MTXP02I7GJA.52.3.A03.1.454.CMB.2.raw
  modified_base (314)..(314): a, c, t, g, unknown or other
  modified_base (555)..(555): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactgggtggaggtcggggggagcggtggtccagccgtgggacgtccctgacgtactttccgtgtcgacggtccttcgtggtatttcgtaggttttagttatttttgcctatgctacgtcggtcccncgaggcctccgaggcgaaggggctggagtggggtggtcggttgtgtaccaaagttgtaggactaagtagtacttatatgcagtcgtcgtgggacggggtccgttcaccgtctcgagactaactactcccaagtaattacttgttatactctagaactaaagtagtaaacctaaggtttcgggccttagaacgtacgtacggtcttaggtttactacgttgataagaaacggtgggaaagtntacgactaaactaacggttacgaaaacctaaccgttaacgttaactttttacaacgttagtaccgtacggttcggtacggtaaccgg

SEQ ID NO: 431753 - DNA, 619 bp, Homo sapiens
  misc_feature: GZ8MTXP02ITYEL.52.3.A03.1.454.CMB.2.raw
  modified_base (244)..(244): a, c, t, g, unknown or other
  modified_base (436)..(436): a, c, t, g, unknown or other
  modified_base (442)..(442): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcggggggagcgtggtccagcctgggagtccctgagtactttccngtgaggtcctcgtggattcgtaggtttagtatttttgcctatgctacgtcgggtccgccaggcctccgagggcgaaggggctgggacggtggggtggtcgggttgtcgtccaaatagtaggggtactaaagtagatattatgcagtacctcgtggacggggtccgttcaccgtctcagcacatcccagaatnttgttntatctagacaaatgaaactaaagtttgggacctaggaacgacgtaacggtcttaggtttattacgtgttagaacgtaaaaggtcgggtaaacggatacggctaaactagttacgaactaaccgtaacccgtttaatttttaccgtaacgttactagtacggttacgtacggtaccgg

SEQ ID NO: 431754 - DNA, 703 bp, Homo sapiens
  misc_feature: GZ8MTXP02F8PMN.52.3.A03.1.454.CMB.2.raw
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcggggggaggcgtggtccagcctggggaggtccctgagactttcctgtgaggcctctggattcaggtttagtatttttgccatgcactgggtccgcaggctccaggcaaggggctggagtggggtggcggttgtgtaccaatagtgggactaagtagaattattaatgacagacctccggtggacgggggccggttcacccggtctacccgagacgaacaactttaccccgagtaaactagttgtttagtactacgttggaactaaaagtacgtaaacgtaaagttttcgggggttacccttaggaaacggtaccgtaacgggtaccgtttaggttttaatttaccgttaggttacggaaaccgtaaaaaggggttaccggggaaaagggtaacttaacgggaccaaaccgttaaagttacgggttaaaccaaaacgttaaaccccgtttaacgttttttacctaacttacgttacggtacggttaccgtagggttaacccgg

SEQ ID NO: 431755 - DNA, 638 bp, Homo sapiens
  misc_feature: GZ8MTXP02I37GJ.52.3.A03.1.454.CMB.2.raw
  modified_base (246)..(246): a, c, t, g, unknown or other
  modified_base (258)..(258): a, c, t, g, unknown or other
  modified_base (303)..(303): a, c, t, g, unknown or other
  modified_base (403)..(403): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaacaggtggaggtcggggggaggcgtggtccagccgtgggaggtccctgagtactttccnggtgaggccctntggtattcgtaggtttagtatttttgcctatgcacgtgggtcccnccgaggcctccgaggcgaaggggctgggaggtggggtggcgggttgtgtaccgaaaagttgtaggggaactaaagtagattattatgacagaccgttcgnggacggggtccgttccgaccgtctccgagacgtaacaattcccaagtaatatgttagtatctagactaaatcgtaaacgtaaacgtttgggaccttagaaacgtacgacggtcttagtttattactgtagactaaaaggtcgggtaaagatacgactaaactaagttacgtaaacctaacctaaacccgtttaatttttacgaacttacgtacgtacggttacgtacggtaacgg

SEQ ID NO: 431756 - DNA, 677 bp, Homo sapiens
  misc_feature: GZ8MTXP02IT3L7.52.3.A03.1.454.CMB.2.raw
  modified_base (432)..(432): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaacgtggtggaggtcgggggaggcgtggtccagccgtgggacggtccctgagtactttccgtgtgacggcctcgtggtattcgtaggtttagttatttttgcctattgctacgtcgggtcccgccgtaggcctaccgaggccgaaggggtcgtggaggtcggggtggtcggttgtcgtaccgaaaagttggtacgggtaactaaagtaagtattaacgttaagtgacctaaggtaccgttccggnggggtacggggtcccggttaccacccgtctaccgagacgactaaacgttcccaagtaatagtgttatatctagacaaagtgaaactagtttcgggtacctagaacgacgtacgtagttagtttattagtgtagaacgaaaacggtttggaaagtatacgacaacctaaagttaccggtaaactaaacccgttaaccgtttaatttttaccgaacttacggtacgtacggttacgtacggtaccgg

SEQ ID NO: 431757 - DNA, 649 bp, Homo sapiens
  misc_feature: GZ8MTXP02JJS2A.52.3.A03.1.454.CMB.2.raw
  modified_base (291)..(291): a, c, t, g, unknown or other
  modified_base (368)..(368): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggagtcgggggagcgtgtccagccgtgggagtccctgagtactttcctgtgaggcctctggattcgaggtttagtattttgcctatgcactgggtccnccaggcctccgaggcaaggggctggagtggggtggcggttgtcgtacaaagtagtgggaactaaagtagattattangtacagtactccgtgggacggggtcccgttcaccgtctaccagacgactaagttcccaagaacttagtcgttagtaactcgtagacaaagtgaaactaagtttcgggtacctagaacgtaccgtacgggactttagtttaacgtactggttagaaccgtaaaaggtcgggtaagacgttaacgaccgtaaacctaaagtttacggtaaacccaaccgttaaaacccggtttaattttttaccgaactttagtacgtacccggtttacgtacggtaacccgg

SEQ ID NO: 431758 - DNA, 729 bp, Homo sapiens
  misc_feature: GZ8MTXP02GB8LX.52.3.A03.1.454.CMB.2.raw
  modified_base (245)..(245): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcgggggagcgtggtccagccgtgggacggtccctgagtactttccngtgacggtcctcgtggtatttcgtaggttttagttatttttcgcctatgcgtacgtcgggtccgccgaggcctccgaggtcgaaggggctgggaggtggggtggtcggttgtcgtaccaaagttgtacggggtaactaaagtaggtaattaacgttagtacgacgtaacgtaacccgttccgggtggggaccgggggtcccggtttacccgaacccgtccgtacccgaaggaacgaactaactttaccccgaaggtaaattagttgtttagtacttaccgtaagaactaaaagttacgtaaaactttaaggtttcggggaccttaggaaacgtaccgttaacggttctttagtttaacttacgttaggtaacgaaacggtaaaacggtacgggaagtacgttacggaacctaaacgtagttaacgtaacctaaaccgttaccgtttaagttttacaacgttacgtacggtcgtactggtaaccg

SEQ ID NO: 431759 - DNA, 682 bp, Homo sapiens
  misc_feature: GZ8MTXP02FGXXE.52.3.A03.1.454.CMB.2.raw
  modified_base (375)..(375): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaactggtggagtcgggggagcgtggtccagcctgggaggtccctgagactttcctgtgaggtcctcgtggattcgaggtttagtatttttgcctatgctacgtcgggtccgccaggctcaggcaaggggctggagtgggtggtcggttgtcgtccaaaagtacgtgggactaaataggatagttaangacagacctccggtggacggggccgttcgaccgtctacagacgacaattcccaagtaatagtgttgtatctagactaaaagtgaaaaccgtaagtttacgggtcccttaggaaacgtaaccgtacgggtacctttaggtttaatttacgttggtacgtaaacgtaaaaaggggtccgggggtaaaaaggtagttacgggaacctaaacgtaaacgtttacgggtaaacccaaccgtttaaaacccccgtttaattttttaaccgtaaacttacgttacggtacggttaccgttagggttaacccggg

SEQ ID NO: 431760 - DNA, 644 bp, Homo sapiens
  misc_feature: GZ8MTXP02FRL9F.52.3.A03.1.454.CMB.2.raw
  modified_base (187)..(187): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggancaacgtggtggaggtcgggggaggcgtggtccagccgtgggacgtccctgagtactttcctgtgaggcctcgtggattcgaggttttagttattttgcctatgcacgtgggtcccgcgacggcctcgacggcgaagggggctaggggacggtggggtggtcggtttgtcgtacctaaagtgtaggggaactaaagtagattattatgacagcctcgtggacggggtccgttcaccgtctacagacgaactattcccaagaacttatgttagtatctagacaaaagtgtaaaccttaagtttcgggtaacctggaaacgaccgtacgtacttaggttttactacgttgtagaacgtaaaaggtacgggaaggtacaggaccgaactaagtttacggaaactaacccgttaaaccgtttctttttaactacgttagtagtaaccggtgtacggttaccg

SEQ ID NO: 431761 - DNA, 711 bp, Homo sapiens
  misc_feature: GZ8MTXP02HE5QS.52.3.A03.1.454.CMB.2.raw
  modified_base (246)..(246): a, c, t, g, unknown or other
  modified_base (250)..(250): a, c, t, g, unknown or other
  modified_base (254)..(254): a, c, t, g, unknown or other
  modified_base (376)..(376): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgcttcttttaagaggtgtccagtgtcaggagcaacgtggtggaggtcggggggagcgtggtccaggccgtgggagtccctgagtacttcngtgngctntgattctagtttagtattttgcatcgcacgtcggtccgccaggcctccgaggcgaaggggctgggaggtggggtggtcggttgtcgtaccaaagtgtagggtaactaaagtagattacttancgactagtaccgtccgtggggacggggttcccgttccaccgtcctcgaaagacgaaactacttacccggaaataattataggtttataactcgttagaaacctaaagttagaaaaccgtttaaggtttcggggtaccttaagggaaacgtaccggtaccggttcttagttttacgtacgttaggtacggaaaaggtaaaacgggtacgggtaaaagtacgttaacgaaccgtaaaaccgttaaagtttaccggaaaaccctaaaccggttttaaacccgtttaagtttttaacaaccggtttaagtcgggtaacgttcggtacggttaacccggg

SEQ ID NO: 431762 - DNA, 697 bp, Homo sapiens
  misc_feature: GZ8MTXP02IBNC0.52.3.A03.1.454.CMB.2.raw
  modified_base (181)..(181): a, c, t, g, unknown or other
  modified_base (250)..(250): a, c, t, g, unknown or other
  modified_base (599)..(599): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctgttgcttcttttaagaggtgtccagtgtnaggagcaacgtggtgggaggtcggggggaggcgtggtccagccgtggggaggtccctgagtactttccngtggaggtcctcgtggtattcgtaggtttagtattttgctatgcacgtcggtccgcaggtcctaccgaggcgaaggggctaggtaggtggggtggtcggttgtacgtaccaaaagtagtacgggtaactaaagtagtattaattatcggactaagaaccgttccgggtagggtaccgggggtacccgttaccgtacccgttccgacgaacgaacgtaaacctaaccgttaacccaaagtaattacgtgtttacgatctaggaaactaagtaagtaaactaaaggtttcggtaacagaaacgacgtacgtcttagtttaatcgtagtacgtaagaaaaggaacgggtaanaagtacgaactaacgtaaagttacgtaaacctaaaaccgtaccgttttaactttttaccgaaactttagtacggtaccggtacgttacgggtaacccg

SEQ ID NO: 431763 - DNA, 699 bp, Homo sapiens
  misc_feature: GZ8MTXP02IDY0U.52.3.A03.1.454.CMB.2.raw
  modified_base (167)..(167): a, c, t, g, unknown or other
  modified_base (250)..(250): a, c, t, g, unknown or other
tcagcgcagtacgacacgaccggtgctcgatttagagagcgtcacaggggggagaggagcccagcactagaagtcggcggtgtctccattcggtgatcagcactgaacacagaggactcaccatggagttcgggctgagttgggtcttcctcgttgctcttttaagnggtgtccagtgtcaggagcaacgtggtgggagggtcggggggaggcgtggtccaggccgtgggacggtccctgagtactttcngtgaggcctcgtggtattctaggtttattattttgcctatcgcacgtcggtccgccgaggcctccgaggccgaaaggggtctgggaggtggggtcgggtcggttgtcgtaccaaaagtgtaggggaactaaagtagattaacttagtgacgaggtaccgtccgggtgggaccgggggtcccgttacctaccgttccaccgagacgaaaccgtaaactaccccgtaaagtaacgttattagggtttagtaacttccgtaggaaacctaaagttacgtaaaaccgttaaggttttcggggtaaccttaggaagtaaccgtacggttacgttagttttaatacgtgttacgaacgtaaaaggtacggtaacgatacgactaacgaagttacggaaactaacctaaccgtttaacttttcgaacttacgtacggtaccggtgtacggtaccgg

SEQ ID NO: 431764 - DNA, 580 bp, Homo sapiens
  misc_feature: GZ8MTXP02GB1UC.52.3.A03.1.454.CMB.2.raw
  modified_base (436)..(436): a, c, t, g, unknown or other
  modified_base (467)..(467): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaactggtggaggtcggggggaggcgtggtccagcctgggagtccctgagactttcctgtgaggcctctggattcaggtttagtatttttgccatgcacgtggtccgccaggctccaggcaaggggctggagtgggtggtcggttgtgtaccaaagtgtagggactaaatgactatatgcagacctccggtggacggggccgttcgaccgtctaccgagcgaacaattcccaagaacttatgttatactntgacaaatgaaactagtttggtcctaggaanacgacgtctagtttatactgtagaactaaaggtcggaaggatagacaacgtaattcgaaactactaacccgttaatttttacgtaacttagtacgtacggtctacggtaccgg

SEQ ID NO: 431765 - DNA, 773 bp, Homo sapiens
  misc_feature: GZ8MTXP02IGVY7.52.3.A03.1.454.CMB.2.raw
  modified_base (251)..(251): a, c, t, g, unknown or other
  modified_base (306)..(306): a, c, t, g, unknown or other
tcagcgcagtacgacacgaccggtgctcgatttagagagcgtcacagggggggagaggagcccagcactagaagtcggcggtgtctccattcggtgatcagcactgaacacagaggactcaccatggagttcgggctgagttgggtcttcctcgttgctcttttaagaggtgtccagtgtcaggagcaacgtggtgggaggtcgggggggaggcggtggtccagccgtgggaggtccctgagtactttcgngtgaggcctcgtgtattcgtaggtttagttattttgctatcgctacgtcgggccncgaggcctccgaggacgaaggggtctgggaggtggggtggtcggttgtcgtaccgaaagttgtacgggaactaaagtagtactaagtttagtacgacgacgtaccggttcccggttagggggaccgggggtcccgttacccggtaccgttacccgtaccggaaagggtactaaacccgttaactacccccgtaaaggtaaactttagttacggttttagtaacgttacgtacggtaaactaaaacgttacgtaaaaccctttaaaggttttccgggggtaaccctttaagggaaaccggtaaccgtaaccgggttcgtttaagggttttaacttaccgttggttaaacgaaaccgggtaaaaagggtccggggtaaaagtacgttaccgacttaaaccggtagtttaccggaaaacttaaccgttaccgtttaattttaccagttacacggtacgtcgtacggtcgg

SEQ ID NO: 431766 - DNA, 566 bp, Homo sapiens
  misc_feature: GZ8MTXP01EFFC3.9.43.D10.1.454.CMB.2.raw
  modified_base (559)..(559): a, c, t, g, unknown or other
tcagtgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagctattggtggttatgactatgtctcctgtatcaacaacaccagcaaacgccccaaatcttgatttatgaggtcagtaggagccctgagggtccctgacttcgcttctctggctcctaagtcctcgacccaacgaccggcccctccctcgacccgtctcgtcgggcctccgaggtcctaggaggtatggaggtctagtaatttattattgcagtctacattattcgaggtactaggtaacgtaggggtttcggcgggtaacgggacaagtcgtcgaccgtcgtaggttcacgcccgaaggcttccgccccttggtcctactctcgtccccacccttccncgtaacg

SEQ ID NO: 431767 - DNA, 575 bp, Homo sapiens
  misc_feature: GZ8MTXP01BM4OK.9.43.D10.1.454.CMB.2.raw
  modified_base (288)..(288): a, c, t, g, unknown or other
  modified_base (432)..(432): a, c, t, g, unknown or other
tcagtgatacgtctcacgaccggtgctcgatttagactagcagtaaggggggagaggagcccagcactgggattccgaggtgtttccattcggtgatcagcactgaacacagaggactcaccatggagttttggctgagcgtggtttctgttgttattctaaaggtgtcagtgtgaggtgcaatggtggagagtggaggaggcttgatccagccgtggggggtccctgagactctcctgtgcagcctctggcttcgccgtcagtggcgactacatgacctgggccccnccaggctccgaggggaagggctgggaatgggtctcgagtttattcattaccgacggtacatactatgacgcagaactccgtgaaacgggccattcacatctaccagacgaccattccaaagaacaccctatatcttacaaagtnaaacaacctggaagagtacgaaagaccacgggtcctaatagttactgtgcgagaactaagttgtaacgtttcgggacgtaaccccgttgggggccgaacggggtaacccctgggtccacccggttcttccctcaacgtccccg

SEQ ID NO: 431768 - DNA, 579 bp, Homo sapiens
  misc_feature: GZ8MTXP01BGOBW.9.43.D10.1.454.CMB.2.raw
  modified_base (232)..(232): a, c, t, g, unknown or other
  modified_base (356)..(356): a, c, t, g, unknown or other
tcagtgatacgtctcacgaccggtgctcgatttagactagcagtaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtgttangactatgtctcctggtatcaacaacacccaggcaaacgcccccaaatcttgatttatgaggtcagtaggaggccctcgagggggtcccctgactcggcttctctggctccaagtctgcccaacnccggccctccctgacccgtctcgtcgggctccgaggctgaggatggagctgtattattattgcagtctcattattcagggacctaaggtaacgtagggggttttccgacgggtaacgggaccgtaaggctcggtaccgtaaccgtaggttccacgcccgaaaggccttaccggccccgttcggtccaccgttccgtcgtttccccacccttccttcgtaaccg

SEQ ID NO: 431769 - DNA, 884 bp, Homo sapiens
  misc_feature: GZ8MTXP01B905I.9.43.D10.1.454.CMB.2.raw
tcagtgatacgtctcacgaccggtgctcgatttagactagcagtaagggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagaggtggaggaggcttgatccaggccgtgggggtccctgagactctcctgtgcagcctctggcttcgccgtcagtggcgactacatcgaccctcgggccccgccgaggcctacccggaaggggggaaacggggcgtaggggtaaagttcgggggttaccttccgtaaggttttaactttaccgaaacgtttaaccccgggaaaccggttaaccctaaattaaacttaacgtacggaaaccctaaaccgaacgggtaaaacccgtttaccccgggttaagggaaaaaccgggggtccccgtaaactttaccccgaaaccccctaaacgttccccgtacccccaaaggaaacccggtaaaccccctaaacgtttaacccccaaaaaaacgtaaacccctaaaccccctttaaatttaaactttaccccttttaaacccaaaaaagtttccgaaaaaacccctaaaccccgttagggggaaaacggtaacggggtttaaacccggaaaacgtaacccgaaacccgggtaacccggtttaaattaaaccgtttaacctgggtacgaccggaaagaaaccctaagttcgtaaacccgtttccggggaccgtaacccccggttggggggccccaaacgggggtaaccccctggggttccccaacccggttccttccctaaccgaaccggtccccc

SEQ ID NO: 431770 - DNA, 631 bp, Homo sapiens
  misc_feature: GZ8MTXP01E1ELO.9.43.D10.1.454.CMB.2.raw
  modified_base (526)..(526): a, c, t, g, unknown or other
tcagtgatacgtctcacgaccggtgctcgatttagactagcagtaaggggctgggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagaggtggaggaggcttgatccagccgtgggggtccctgagactctcctgtgcagcctctggcttcgccgtcaggtggcgactacatcggacccgtcggggcccccgccgaggccgtacccggagggggaacgggggcgtagggaagtggggtctcgtagttacttcacgtaccgacggtacccatatatcgacgacagcctcggtagaacgggcctacttacacctatcctaccgaagacgacctacttaccaaacgacctaccctatactcttaacaaatcgaaactactagagacgtacgaagaccgtacggctaatacttacgnggtgaacgagactagttacggtaccgttccgggaccgttcccggggttacggggaacccgtacgggtaacccgtcggtacccttacccgttccgttcccgaaccg

SEQ ID NO: 431771 - DNA, 568 bp, Homo sapiens
  misc_feature: GZ8MTXP01AW3QS.9.43.D10.1.454.CMB.2.raw
  modified_base (220)..(220): a, c, t, g, unknown or other
  modified_base (292)..(292): a, c, t, g, unknown or other
  modified_base (371)..(371): a, c, t, g, unknown or other
tcagtgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcattgggtgttatgactatgtctcctgtatcaacaacacccaggcaaacgcccccaaaatcttagatttangaggtcaggtaggaggcccctgagggggtcccctgatcgcttctctggctccaagtctgcccaacaccggcccttcccngacccgtctcgtcggggcctccgaggtctaggaggagtggaggcttagtatttattattgctagtctatataacttcaggtcaaggttaaacgtggggtttcggcgggtaagggacccaagctcgaccgtcgtaagggttcacgccgaaggccttccggccccttcggtccactcctcgttcccacctcttcgaacg

SEQ ID NO: 431772 - DNA, 559 bp, Homo sapiens
  misc_feature: GZ8MTXP01C5Z8T.9.43.D10.1.454.CMB.2.raw
  modified_base (296)..(296): a, c, t, g, unknown or other
  modified_base (397)..(397): a, c, t, g, unknown or other
  modified_base (495)..(495): a, c, t, g, unknown or other
  modified_base (539)..(539): a, c, t, g, unknown or other
tcagtgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtgggaggaggcttgatccagccgtggggggtccctgagactctcctgtgcagcctctggcttcgccgtcagtggcgactacatgacctgggccccnccaggctccgaggggaaggggctgggaatgggtctctagttatcataccgacggtacatatatgacgcagaactccgtggaaacgggccattcaccatccnccagacgaccattaccaagaaccacctatactcttacaaatgaaacaacctgggagagtacgaacgacgacggccgtaatactactgtgcgaagaacnttgacgttcggtcgacccgttggggccacgggaaccctggtccnccgtcttcctcgaacgtccc

SEQ ID NO: 431773 - DNA, 631 bp, Homo sapiens
  misc_feature: GZ8MTXP01EKINP.9.43.D10.1.454.CMB.2.raw
  modified_base (372)..(372): a, c, t, g, unknown or other
  modified_base (520)..(520): a, c, t, g, unknown or other
tcagtgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagaggtggaggaggcttgatccaggccgtggggggtccctgagactctcctgtgcagcctcgtggcttcgccgtcagtggcgactacatcgaccgtgggccccgccaggcctccgagggggaagggctgggaatgggtctcagtttattcatacccgaggtaccattatatggacncagtaaccgtccgtaaggaacgggcccgaattccacctactctacccgagacgaccctattaccaaagaaccctaccctatactacttacgaaaatgaaaccaaccgtgggacgaagtaccgaaagaccgacggccttatattactgngaccaagctagttcgtaccgtttggccggaacccccggttgggggcccttaaacgggggtaaccccttgggccctaacccggtcccttaccgttccgaaccggtaaccccc

SEQ ID NO: 431774 - DNA, 640 bp, Homo sapiens
  misc_feature: GZ8MTXP01ATEII.9.43.D10.1.454.CMB.2.raw
  modified_base (261)..(261): a, c, t, g, unknown or other
  modified_base (276)..(276): a, c, t, g, unknown or other
  modified_base (302)..(302): a, c, t, g, unknown or other
  modified_base (383)..(383): a, c, t, g, unknown or other
  modified_base (615)..(615): a, c, t, g, unknown or other
tcagtgatacgtctcacgaccggtgctcgatttagactagcagtaaggggctgggagaggagcccagcactgggattccgaggtgtttccattcggtgatcagcactgaacacagaggactcaccatggagttttggctgagcttgggttttccttgttgttatttctaaaggtgtccagtgtgaggtgcaacgtggtggagagtggaggaggcttgatccgagccgtggggggtccctgagactctcctgtgcagcctcnggtcttcgcgtcagnggcgactacatcgaccgtgggccccncgagggccgtaccggaagggggaaggggctagggaagtcgggtctacgtagttatacgacgtaccggacgtacccatatangacacacgcgtccgtagaaccgggcctattcacctattccacgagacgacctacttacccaaaacgaccaccttaatacgttacctaacgaaaatcggaaaccctagtaggaagaacgtaccgaaagaccgacgggtaccttaatacgttacgtggagaacgaagttactacttcgaaccggtttcgggacccggttcccgggttaccggggaaccaacgggggtaaccccngggtcccttacccgtcgttcctccg

SEQ ID NO: 431775 - DNA, 716 bp, Homo sapiens
  misc_feature: GZ8MTXP01B9DH1.9.43.D10.1.454.CMB.2.raw
  modified_base (236)..(236): a, c, t, g, unknown or other
  modified_base (512)..(512): a, c, t, g, unknown or other
tcagtgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctgcctccgtgtctgggtctcctggacagtcgatagccatctcctgcactggaactaacagtgacgttggtncttaataattatgtctcgtgtatacaacaacaccagacaaacgccccaatctattattctgatgtacaaactaacgtccggacccctagggtactttcgtagtacttcgtcttcgtcccgtcggtacttaccgtaaacgtctaacgggacccaaccggtacccggtacccctacccttacgaccctacgttccgtccggttcggggtcccgttccgggggcttacggggaacgggtaaccggtacggtaccttacgtaacctttaacgtttaccgnggtaccctagttaccttaactaaacgttaaactaaacccgaaaccacggtacccgtaactaccgtttcgttagggtttcgggttaccggggacgggtaacgggtacttaggtaaaccgttccggtaaccgttcggttacggttccgaccggtcccggaaggtccgtaccccggtccccgttcggttaaccttccgtttccccgg

SEQ ID NO: 431776 - DNA, 545 bp, Homo sapiens
  misc_feature: GZ8MTXP02I9TYQ.9.43.D10.1.454.CMB.2.raw
  modified_base (446)..(446): a, c, t, g, unknown or other
  modified_base (472)..(472): a, c, t, g, unknown or other
tcagtgatacgtctcacgaccggtgctcgatttagactagcagtaaggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggccccgccaggctccgaggggaagggctggaatgggtctcagttatcataccgacgtaccatatatgacgcagactccgtgaagggccgattccaccatcctccagacgacccattaccaagaaccaccctatactcttacaaatcgaaacacctgaanagtacgaagacacgccgtatattacngtgacgagacatgacttcggtcgacccgtggggccaacgggaaccctggccaccggtcacccgtcacgtcccc

SEQ ID NO: 431777 - DNA, 574 bp, Homo sapiens
  misc_feature: GZ8MTXP02JN6CC.9.43.D10.1.454.CMB.2.raw
  modified_base (287)..(287): a, c, t, g, unknown or other
  modified_base (356)..(356): a, c, t, g, unknown or other
tcagtgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctctggtatcaacaacaccaggcaaacgccccaaatctgatttangaggtcagtaggacggccctcgacggggtccctgacttcgctttctctggctccaacgtctcgccaacncggccctccctgacccgtctcgtgggctccgagctgagatgaggctgtattattattgcagctcattattcgagtctaaggttaacgtaggggtttcggacgggtaggaccgaagtcgtacgtaccgtccgtaggtccacgcccgaaacggtcctaccggcccccgttcggtcctaccgttccgttccggttccccacccgttccctaccgtaaccgg

SEQ ID NO: 431778 - DNA, 634 bp, Homo sapiens
  misc_feature: GZ8MTXP02G8HGO.9.43.D10.1.454.CMB.2.raw
  modified_base (280)..(280): a, c, t, g, unknown or other
  modified_base (525)..(525): a, c, t, g, unknown or other
tcagtgatacgtctcacgaccggtgctcgatttagactagcagtaaggggctgggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagccgtgggggtccctgacgactctcctgtgcagcctctggcttcgcgtcagtgcactacntcgaccgtcggcccgcaggctccgaggggagggctaggaagtgggtctcgtagttactacacgtaccgacggtaacccatatatcgacgacacgacgtccgaggacggtaccgtatttaacccgatcctaccgaagaacgtaccctaacttaacccaaagtaaacctaccctattaacttacttaaacaaaattacgaaacctaaacgtgaagagtacgaaagaccacggtacttataacttcgngtacgacgagacattacggtaccgttacgggtccgaacccccgggttaggggaccccgtaacgggggaaccccttcggggaccctacccggttctccccgtacgacccg

SEQ ID NO: 431779 - DNA, 748 bp, Homo sapiens
  misc_feature: GZ8MTXP02GLXKU.9.43.D10.1.454.CMB.2.raw
tcagtgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagccgtgggggtccctgagactctcctgtgcagcctctggcttcgccgtcagtcggcgactacatcgacccgtcggggcccccgccgaggcctacccggagggggaaacggggccgtaggggaaagtcggggtctacgtagtttacttccgaaacgtaacccggaacggttaacctaataactaagtacgaacgactacgaaccgtcccgggtagggaaacggggtcccgtaactttaccaaccctaacttcctacccaaaggaaccgtaaaccctaactttaaacccgaaacgaaaacccctaccccctaattaacttacccttaaacaaaaattacgaaaaaccctaaaccgttaggaaacggtaacgtaccggaaaacggaaccgaaacccgggtaccgttaaattaacttacgtggtacgacgaacgactagtcggtaaccgtttcgggaccgtacccccggtacgggggacccgtaacggggaaacccctcgggtaccaccccggtctaccctacgacgtaccccc

SEQ ID NO: 431780 - DNA, 687 bp, Homo sapiens
  misc_feature: GZ8MTXP02HHXNT.9.43.D10.1.454.CMB.2.raw
tcagtgatacgtctcacgaccggtgctcgatttagactagcagtaaggggctgggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagccgtgggggtccctgagactctcctgtgcacgcctcgtggcttcgccgtcaggtggcgactacatcgaccgtcggggccccgccgacggcctcccgaggggaaggggcgtagggaagttggggtctacgtagtttacttcagtaccggacggtaccccatatatcgacacacgaccgtccggtaggaacggggccgtaacttccgaaccctattccctaccgaacggtacgaaccctaactttaacccaaaacgtaaccccaacccttaattaacttaccttaactaaaacgttacgaaacaacccgttagaagtaacggtacgaaacgacgacggtaccgtaagttacttacgtgtacgacgaagactacgtcggtaaccgttaccgggtaccgtaccccggtacgggggccccgaaaacggggtaccccgtcgggtacccgtacccggttcctacccgtacccg

SEQ ID NO: 431781 - DNA, 689 bp, Homo sapiens
  misc_feature: GZ8MTXP02GW0CR.9.43.D10.1.454.CMB.2.raw
  modified_base (539)..(539): a, c, t, g, unknown or other
  modified_base (606)..(606): a, c, t, g, unknown or other
  modified_base (666)..(666): a, c, t, g, unknown or other
tcagtgatacgtctcacgaccggtgctcgatttagactagcagtaaggggctgggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagaggtgggagggaggtcttgactccgaggccgtcgggggtccctgagactctcctgtgcacgcctcgtggtcttcgccgtcgaggtggcgtactacatcgaccgtcgggccccgccgacggccgtaccggaaggggacggggcgtagggaacgttcggggtcctacgtaagttacttaccgaacgtaaccggtaacggtaacccctaattaacgtacgtacgaaccgacgaacggtaccgtaccgggtagggaaccgggggtacctacgttaccaacctactcctaccgaaagacaacctactaacccgaaaataccctaccttaattactaccttaaanaaaacgtcgaaaaccctacgtaggaagtacggaacgaaaccacggaccggtacttaatacgtttagngtacgacgaagactagtcgaccgtttcggaccgacccggtgggaacccgacgggtacccncgtacccaccgttctacccgacg

SEQ ID NO: 431782 - DNA, 712 bp, Homo sapiens
  misc_feature: GZ8MTXP02HJU74.9.43.D10.1.454.CMB.2.raw
  modified_base (284)..(284): a, c, t, g, unknown or other
  modified_base (343)..(343): a, c, t, g, unknown or other
tcagtgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcattggtggttatgactatgtctctgtatcaacaacaccagacaaacgccccaaatctgattangagtcagtagagccctgagggtccctgatcgcttctctggctccaagtctcgaccaacnccggcccttccgtcgacccgttctccgtcggggccttacccgagggtccgtaggacgggtaacgttggaacgggtccgttaggtaactttttaagtttaagtttcggaccgtaacggtcctttaccgtaaatttacgtttacgaacgggtacctaaacgggtttaaaccgttacgggggtttttaccggggacggggtaaaccggggtaaccgtaaacggtccggtacgtaaccccggttaccggtaacgggttaccgaaccggtacccgaaacgggtcccgttacccggtaccccccgttcggtaacccgttaacccgttcccgttcccggttacccccggtccccttaccccgtaccgtaaacccgg

SEQ ID NO: 431783 - DNA, 675 bp, Homo sapiens
  misc_feature: GZ8MTXP02ITZ4E.9.43.D10.1.454.CMB.2.raw
  modified_base (291)..(291): a, c, t, g, unknown or other
  modified_base (326)..(326): a, c, t, g, unknown or other
tcagtgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagctagttggtgttatgactatgtctctgtatcaacaacaccagacaaacgcccccaaatctagtatttangagtcagtaggacgcctacggacgggtcctgatcncttctcgtggctccaacgtctcgaccaacgaccggtccctccctcgtacccgttctccggtacggcctccgagggtctacggaggacgttaggaacggtcgttagtaatttagttatttgctacgtctataattacgttacgaggtacctaaagggttaccgttaacgggggttttaccggggacgggtaacgggaaccgtaaggaccgtaacggtaccccgttacgtacgggtaccgaaccggtacccgtaacgggtcccctccgggtccccccgttacggggttaacccctacgtacccgtttccccggttaccccctacccccgtttccctaaaccgttaacccgg

SEQ ID NO: 431784 - DNA, 599 bp, Homo sapiens
  misc_feature: GZ8MTXP02GN2MC.9.43.D10.1.454.CMB.2.raw
tcagtgatacgtctcacgaccggtgctcgatttagactagcagtaaggggctgggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagccgtgggggtccctgagactctcctgtgcagcctctggcttcgccgtcagtggcgactacatcgaccgtcgggccccgcgacggcctcccgaggggaaggggctagggaagtgggtctcgtaggtttactcgaacgtaccggcggtaaccccatatagtgacgcacgacctccgtaggaacgggccgattcacctatcctacagacgaaccataccaaacgaacctaccctaatactccttacaaaatcgaaaccactgaagacgtacgaaagaccgacggccgttaatattacgtgtgacgagacagtacgacgttccggtaccgaccccggtggggaacccaacggggaccccttgggcccaccgtcctacctccg

SEQ ID NO: 431785 - DNA, 653 bp, Homo sapiens
  misc_feature: GZ8MTXP02HSMLS.9.43.D10.1.454.CMB.2.raw
  modified_base (251)..(251): a, c, t, g, unknown or other
tcagtgatacgtctcacgaccggtgctcgatttagactagcagtaaggggctgggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagccgtgggggtccctgagactctcctgtgcngcctctggcttcgccgtcagtgcgactacatcgaccgtcgggccccgccgacggcctacccggaaggggaacggggacgtagggtaaaggtcggggtacttcgtaagtttacttcgaacgtaccggtacggtaacccattatatagacgcaagccgtcggtagaacggggtccattcacctactctacagacgaccctatacccaaagaacctacctaatactactacaaatacgaaactaacgtagagagtacgaaacgacacgtacgtaactagtacgtgtacgacgtaacgaactcgtgtaaaccgttccggggttaccgacccccgggtaggggaaccccggtaacggggtaaccccgttacggtacccgttacccggtaccttacccgtaaccccgg

SEQ ID NO: 431786 - DNA, 674 bp, Homo sapiens
  misc_feature: GZ8MTXP02G3TVU.9.43.D10.1.454.CMB.2.raw
  modified_base (296)..(296): a, c, t, g, unknown or other
  modified_base (580)..(580): a, c, t, g, unknown or other
tcagtgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagccgtgggggtccctgagactctcctgtgcagcctctggcttcgccgtcagtggcgactacatcgacctcgggccccncgaggcctccgaggggaacgggctggaatgggtctcagttatcataccgacgtaccatactatcgacgcagaccgtccgtaggaaacgggccgtaattccgaaccctataccctacccgaaagaaccgtaaccctacttaaccccgaaaagtaacccctaacccccttaattaacttacccttaaacaaaaacttacggaaaaaccctaaccgttaggaaacggtacgtacgaaaacggaccgaccgggtacccttaattacgtaacgtggtcgaccggtaaanactagtacgtaccgttccgggaccgaccccgggtacgggaacccgtaaccgggtaaccctcggtaccctacccgtcctccaccgaccgtccccg

SEQ ID NO: 431787 - DNA, 594 bp, Homo sapiens
  misc_feature: GZ8MTXP02FXOGU.9.43.D10.1.454.CMB.2.raw
  modified_base (288)..(288): a, c, t, g, unknown or other
  modified_base (416)..(416): a, c, t, g, unknown or other
  modified_base (433)..(433): a, c, t, g, unknown or other
tcagtgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggaaccagctattggtgttatgactatgtctctgtatcaacaacaccaggcaaacgccccaaactctagatttangagtcaggtacggacggtccctcgacggggtccctgatcgtctttctcgtggtacctccgaagtctcgaccaacaccggccctaccctggaccctctcgtcggccttcgaggctggagtagtgacggntagtattattattgcanctactatatacagactaacgtagtacgggtttcggacgggaggtaccaagtcgtacgtacccgtacgttacggacaccgaccgaaacggtcccgtcccgcccccgttcggtaacctcgttacccgttcccggttaccccctacccttccttaccgtaaacg

SEQ ID NO: 431788 - DNA, 667 bp, Homo sapiens
  misc_feature: GZ8MTXP02JDNIQ.9.43.D10.1.454.CMB.2.raw
  modified_base (222)..(222): a, c, t, g, unknown or other
  modified_base (623)..(623): a, c, t, g, unknown or other
tcagtgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaaccngcagtttggtgttatgactatgtctctaggtatacaaacaacacccaggaccaaaccgaccccctaaactcttacgatttatggtaggtcaggtacggacggtccctaggacggggtccctgactccggtcttctcgtggcctaccgaacgtcctacgaccaaccgcggtccctcccgtcgacccgtctccgtcgggcctccgaggtcgtagacgtacgtgggacggtcttagtatttattagttcgacgtatcttacattacgttcgaaggtacgtaacggttaacggttacgggggtttacgggacggggttaacggggtaccaggtaccgtcgaacccggttacgtacggtacgacggacccggtaaacggtccgttcccgcccccgttcggtaaccncccgttaccgtcccgttccccctaccccttcgtaccgtaaccgg

SEQ ID NO: 431789 - DNA, 572 bp, Homo sapiens
  misc_feature: GZ8MTXP02JZ397.9.43.D10.1.454.CMB.2.raw
  modified_base (291)..(291): a, c, t, g, unknown or other
  modified_base (329)..(329): a, c, t, g, unknown or other
  modified_base (341)..(341): a, c, t, g, unknown or other
  modified_base (346)..(346): a, c, t, g, unknown or other
  modified_base (351)..(351): a, c, t, g, unknown or other
  modified_base (353)..(353): a, c, t, g, unknown or other
  modified_base (357)..(357): a, c, t, g, unknown or other
  modified_base (360)..(360): a, c, t, g, unknown or other
  modified_base (369)..(369): a, c, t, g, unknown or other
tcagtgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagctattggtgttatgactatgtctcctggtatcaacaacaccaggacaaacgccccaaatctagatttangagtcagtagacgccctgacgggtccctgactcgcttnctgctccagtcngcacncgccncngccntcngctcgagcngagatgagctgtattatatcgctagtctacattctcgagctaaggttaacgtgggtttcggacggtacggaccaaggtccgtacggtacccgttaccggttaggaccgacgacccggtaaacgggtccctaccccgggtcccccgttcggtcctaccgtttacccgtcccggtttaaccccctaccctccgttacaacccggg

SEQ ID NO: 431790 - DNA, 676 bp, Homo sapiens
  misc_feature: GZ8MTXP02JMWI8.9.43.D10.1.454.CMB.2.raw
  modified_base (242)..(242): a, c, t, g, unknown or other
  modified_base (288)..(288): a, c, t, g, unknown or other
tcagtgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactcggaaccagcagttggtgttatgactatntctctgtatacaacacaccagacaaacgccccaaatcttgtattanagagtcagtagacgcctcgacgggtcctagactccgtcttcgtcgtcggtacctaccaacgttctcgacccaaaccgaccggtccccttcccctacggcccgttcgtcccgttcgggacccttccgagggtccaggtagagttacgggacgtcgttaggtaaatttgtacgtttcgacgtaacgtcttactaattacgtacgtagacgttaacgggggttaaacgttcggggtttacgggaccgggtaagggtaaccaacgtcgtacgtccgttaccggtacgggtaccaaccgttacccgaaacgggtccctccgggtccccccgttacggaacccttccgtaccgtttccccggtccccctaacccggtttccacgttaaacccgg

SEQ ID NO: 431791 - DNA, 716 bp, Homo sapiens
  misc_feature: GZ8MTXP02G551L.9.43.D10.1.454.CMB.2.raw
  modified_base (626)..(626): a, c, t, g, unknown or other
tcagtgatacgtctcacgaccggtgctcgatttagactagcagtaaggggctgggagaggagcccagcactgggattccgaggtgtttccattcggtgatcagcactgaacacagaggactcaccatggtagttttggctgagtcttgggttttccttgttgttatttctaaaggtgtccagtgtgaggtgcaacgtggtggagaggtgggaggaggtcttgactccgaggccggtcggggggtcctgagactctcctgtgcagtcctcgtggtccttccggcccgtcgaggtcggaccgacttacagtcgacccgtcgggccccgcgacggccgtccgaagggggaacggggcgtagggaagtcgggtctacgtagtttactcgaacgtaccggtacgtacccctatactagtacgacgacacgccgtcgggtaggaaacgggggcctaacgttacccaacctactcccgtaaccaacggaacgtacctaacgttacccaaaagtaccccaaaccttaattactaccgttaaacaaaatacgaaaacctaacgtaggagtacggtaacgaaacggtaccacgggtaccttaaattactttaccgaggtacgacggaaacgttacncgtttaacggaccggtttcccggaccggaccccggttggggaacccgaacgggttacccctcgggtacccacccggttctacccgtaccg

SEQ ID NO: 431792 - DNA, 549 bp, Homo sapiens
  misc_feature: GZ8MTXP02JU8AA.9.43.D10.1.454.CMB.2.raw
  modified_base (389)..(389): a, c, t, g, unknown or other
  modified_base (393)..(393): a, c, t, g, unknown or other
  modified_base (441)..(441): a, c, t, g, unknown or other
  modified_base (472)..(472): a, c, t, g, unknown or other
  modified_base (478)..(478): a, c, t, g, unknown or other
tcagtgatacgtctcacgaccggtgctcgatttagactagcagtaaggggctgggagaggagcccagcactgggattccgaggtgtttccattcggtgatcagcactgaacacagaggactcaccatggagttttggctgagcttgggttttccttgttgttatttctaaaggtgtccagtgtgaggtgcaactggtggagagtggaggaggcttgatccagccgtgggggtcctgagactctcctgtgcagcctctggcttcgccgtcagtggcgactacatcgacctgggccccgcaggcctccgaggggaaggggctggaatgggtctcgagttatcataccgacgtacccatatatgacgcagctccgtagaacggccgatcacntccncagacgacattaccaagaccacctatatctacaaatcgaaacactganacgtacaagacacggactatattactgtacncgacanactagacgttcggaccgaccccgtggggaacccgacgggaacccgtcggtccctaccggtcctccgtaccg

SEQ ID NO: 431793 - DNA, 543 bp, Homo sapiens
  misc_feature: GZ8MTXP01ERLSK.44.5.A05.1.454.CMB.2.raw
  modified_base (287)..(287): a, c, t, g, unknown or other
  modified_base (348)..(348): a, c, t, g, unknown or other
tcagacagtatatacacgaccggtgctcgatttagatagatagacagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagctaatttcattggtaatcatgactatgtctctgtacagcatcaccagcacacgccccagactcgtntattttgagtcaatagccgccctcgagggtcccgatcggtctctggctcagtcaggcaacncgcctccctgaccgtctcgtcgggctcgaggctgacgatgaggtctgattatactgcagctcgatggacgcactatcgtatttgtcgttttcgggcgggaacggtaccgagtacgttcgacccgttcgttacgggttccaacggtaacccaaggtcccgtccggtcccccgttcgggtccttaaccggtttcccg

SEQ ID NO: 431794 - DNA, 568 bp, Homo sapiens
  misc_feature: GZ8MTXP01B158A.44.5.A05.1.454.CMB.2.raw
  modified_base (338)..(338): a, c, t, g, unknown or other
tcagacagtatatacacgaccggtgctcgatttagatagatagacaggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtgttataactatgtctctgtaccaacacaccagcaaacgccccaaatcatgattcatgatgtacagtaatccggccctgtagggggtttctggtcgtctttccncgtggcctccagtctggcaacgaccggcctccctgacctatctctgggcctccgaggctagacggacgagcctgacttatacgtgactagctacaaataagtaaaagacgacaaactacgttagttaatacgttaccggggaacggtaacggggaccctaaaggccgtacggaacccgttccgaaggttccaacggcccgaaggcctccgcccccgtcggttctaacccg

SEQ ID NO: 431795 - DNA, 530 bp, Homo sapiens
  misc_feature: GZ8MTXP01D7YP3.44.5.A05.1.454.CMB.2.raw
  modified_base (523)..(523): a, c, t, g, unknown or other
tcagacagtatatacacgaccggtgctcgatttagatagatagacagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaaatttcattggtaaatcatgactatgtctcctggtaccagcatcacccagcacacgccccagactcgtgtatttttgaggtacaataacgccgcccctcgacggggtcccgatcggttctcctggctccaagtctaggcaacaccggcctccctgaccgtctcgtcgggctcgaggctgacgatgaggtctgattatactagcaggctcgatggagcactatagtatttgtcgtttcgggcggaacgggcagacgttgaccgtcgttagttcacgcccgaagcctcgccccgttcgtccncgttccg

SEQ ID NO: 431796 - DNA, 575 bp, Homo sapiens
  misc_feature: GZ8MTXP01EPKMN.44.5.A05.1.454.CMB.2.raw
tcagacagtatatacacgaccggtgctcgatttagatagatagacgagggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgactagttggtgttataactatgtctctaggtaccaacaacaccaggacaaacgccccaaactcatgattcatgatgtacagtaactccggcctcgtaggggtttctggtcgtctttcctctggcctccgtaagtctagggcctaacgaccggtccctccctgaccctatctcgtgggcctcgaggctaggaggacgaggctagactattactgcagtctacaataaagtaaaagacacaaactattagttaatagttcgggaacgaagggaaccaaggttcgtacgtaccgttccgttaggttcaacgacccgaagggcctccggccccttcggttccgttaaccg

SEQ ID NO: 431797 - DNA, 512 bp, Homo sapiens
  misc_feature: GZ8MTXP01C3DSD.44.5.A05.1.454.CMB.2.raw
  modified_base (273)..(273): a, c, t, g, unknown or other
  modified_base (343)..(343): a, c, t, g, unknown or other
  modified_base (363)..(363): a, c, t, g, unknown or other
  modified_base (419)..(419): a, c, t, g, unknown or other
tcagacagtatatacacgaccggtgctcgatttagatagatagacaggggtgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttgggaggtcagaacatctatgtggactggtactgcagagaccgggnagtctccacaactcctgatctatttgggtccactcgggcctccgggggtctctgacaggttcccaggtcnccagtgccatcacacacagntttcacatgcacatcagcagagtggaggctgacgatggttggggggtctagttacngcatccaagttctactaaaccccgttcaccttcgggaacaagggaccagaattgagttagttaagcgtaactgtggcctgctaaccgaattcg

SEQ ID NO: 431798 - DNA, 599 bp, Homo sapiens
  misc_feature: GZ8MTXP01A6EJ7.44.5.A05.1.454.CMB.2.raw
  modified_base (224)..(224): a, c, t, g, unknown or other
  modified_base (295)..(295): a, c, t, g, unknown or other
  modified_base (300)..(300): a, c, t, g, unknown or other
  modified_base (306)..(306): a, c, t, g, unknown or other
  modified_base (314)..(314): a, c, t, g, unknown or other
  modified_base (318)..(318): a, c, t, g, unknown or other
  modified_base (342)..(342): a, c, t, g, unknown or other
  modified_base (349)..(349): a, c, t, g, unknown or other
tcagacagtatatacacgaccggtgctcgatttagatagatagacgagggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctctgcattggaaccaanagtgacgtcggttcgtttgaccgtgtctcctggtacagcacgacccagaaacacgccccaatcattattangcgtnatgtcnccttcgtntccngagcgcttctcgtggtccaagtcnggcaacnccggccctccctgacccatcctcgtcgggcctcgaggctaggaggacgaggctagtattattacgtgacagctacatagtaacgaaggttacggtaacttactttaacgtacgtttccgggacgtaccgaaggggtacccaaagtccgtcgacccggttcgtacggttccgaacgcccgaacggttccgttcccggtccccccgttacggtccctaccgttccgttccgttcccccgttccccgtttccc

SEQ ID NO: 431799 - DNA, 542 bp, Homo sapiens
  misc_feature: GZ8MTXP01AN7Z7.44.5.A05.1.454.CMB.2.raw
  modified_base (343)..(343): a, c, t, g, unknown or other
  modified_base (488)..(488): a, c, t, g, unknown or other
  modified_base (503)..(503): a, c, t, g, unknown or other
  modified_base (509)..(509): a, c, t, g, unknown or other
  modified_base (531)..(532): a, c, t, g, unknown or other
  modified_base (534)..(542): a, c, t, g, unknown or other
tcagacagtatatacacgaccggtgctcgatttagatagatagacagggggggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccacgtcgggcctccgggggtctctgactaggttcagtgccagtgcatcacacacagtatttcacactgcacactcagcaggagtggagctagacgtagttggttgggtctattaccngacactcctaagttacctaaccctaacccgttcacccgttcgggacaaggggacacgtacttgaagtaattaacggcgtaaacgtggtacggctcgaccacctattctcgttcttaccacttcccgttacccgcctattccgtanattaagttactcgtnttcggnggcggcggcgtggcgaggcagnngnnnnnnnnn

SEQ ID NO: 431800 - DNA, 708 bp, Homo sapiens
  misc_feature: GZ8MTXP01E3IVV.44.5.A05.1.454.CMB.2.raw
tcagacagtatatacacgaccggtgctcgatttagatagatagacaggggggggtctcaggaggcagcgctctcaggacgtctccaccatggcctgggctctgctgctcctcactctcctcacccaggacacagggtcctgggcccagtctgccctgactcagcctgcctccgtgtctgggtcgcctggacagtcgtcaccatctcctgcacgtggagccagcgtaatatttcttagttcttaactttgtctcctggtatcaacatcatccgaaggtaaacgaccccctaaactcatcatactatgacggtacctaaagtaacgacggcccttacgtacgggggttttactaatccgtcttccgactcgtccctaccgaacgtcccggacaaccgaccgggccctccctacgactaactctccgtcgggctaccgacggtcgtaggacggaccggaggtcctaggtaatttatttaattgttcgtaccgggttataggttactttcggttaccggtctctaacttaccttaaccttttaagttcggtttacggtttaacggggtaaacgggttaccggggttaaacccggtaaacggttacccgtacccggttaaccggtttaccgggttccgaacccggaaccccggaaaccgggaacccccgtaaacccctaccgttacggtaaccccgttaacccgtttcccccg

SEQ ID NO: 431801 - DNA, 643 bp, Homo sapiens
  misc_feature: GZ8MTXP01DL56T.44.5.A05.1.454.CMB.2.raw
  modified_base (229)..(229): a, c, t, g, unknown or other
tcagacagtatatacacgaccggtgctcgatttagatagatagacgagggggggggtctcaggaggcagcgctctcaggacgtcaccaccatggcctgggctctgctcctcctcaccctcctcactcaggacacagggtcctgggcccagtctgccctgactcagcctgcctcgtgtctgggtcacctggacagtcgatcaccatctcctgcattcggaaccagcagtnactagttggtagttataactatgtctctagacaacacaccagacaaacgccccaaactcatgattcatgatgtactaacgtaactccggtccgttaggttacgggtttcgtcggttctccttcgtcgtcggcccttaccgaaacgttcgtcgggacctaaacccgccgggtcccctccgtacgaacctcttctcggtcgggtcctcgaggcgtagggacgggtaacgacgggtactacgtaccttaacgttactcggggactacgtacctaacgtaaataaacgtaaaagaacgtaacctaaactacgttagttaacgttcggtaacgggacggttacggaacttacggtcgtcgaaccgttcggttaacggcaccggaaccgtacggccgttaccgtccccgttcgtaacccg

SEQ ID NO: 431802 - DNA, 557 bp, Homo sapiens
  misc_feature: GZ8MTXP01D7MB3.44.5.A05.1.454.CMB.2.raw
  modified_base (222)..(222): a, c, t, g, unknown or other
  modified_base (358)..(358): a, c, t, g, unknown or other
tcagacagtatatacacgaccggtgctcgatttagatagatagacgaggggggggtctcaggaggcagcgctctcgggacgtctccaccatggcctgggctctgctattcctcaccctcctcactcaggacacagggtcctgggcccagtctgccctgactcagcctgcctccgtgtctgggtcacctggacagtcgatcaccatctcctgcattggaaccngcagtgacattggtgttataactatgtctctggtaccaacaacaccaggacaaacgccccaaatcatgatcatgatgtacagtaatccggccctcgaggggtttctggtcgtcttcctcgtggctcagtctgcacncgcctcctgacatctctggctcgaggctggaggacgagctgactattactgacgtagtctacaataaataaaagagacaaaactacttagttataacgtcggggaacggtaagggaacccaaagttcgtacgtaacccgttcgttaagggttccaacgacccgaaggggccctccggcccccttcgggttcctaacccg

SEQ ID NO: 431803 - DNA, 504 bp, Homo sapiens
  misc_feature: GZ8MTXP02HXQY6.44.5.A05.1.454.CMB.2.raw
  modified_base (331)..(331): a, c, t, g, unknown or other
tcagacagtatatacacgaccggtgctcgatttagatagatagacaggggtgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacnggttccagtgccagtgcatcacacacagtatttcacactgcacatcagcagagtggaggctgacgatgttgggtctagtactgcatccaagttctaactaaaccccgttcacccgtttcgggactaaggggacacgacttgagattaacgcgtaaacgtgtggctgcaccatc

SEQ ID NO: 431804 - DNA, 672 bp, Homo sapiens
  misc_feature: GZ8MTXP02IUFG2.44.5.A05.1.454.CMB.2.raw
  modified_base (218)..(218): a, c, t, g, unknown or other
tcagacagtatatacacgaccggtgctcgatttagatagatagacaggggggtctcaggaggcagcgctctcaggacgtcaccaccatggcctgggctctgctcctcctcaccctcctcactcaggacacagggtcctgggcccagtctgccctgactcagcctccctccgcgtccggtctgtcggtcagtcagtcaccatctcctgcactggaaccngcaatttcattggtaatcatgactatgtctcctggtaccagcatcacccaggccacacgcccccagactcgtgtattttgaggtcaataacgccgcccctgacggggtcccgatcggttctccgtggtcctccgaagtctggccacgaccggcctccccgtgacccgttcgtccgtcggggcctccgaggtcctaggaccgtaagtcggagggtctaggtatttacgttaccgtggccaggtccctaccgaagttcggggaacggcctaaccgttaagttggttaacgtttttcggttaccggtttttcggggacggggttaacgggggaaccctacgggttaaaccgttcggtaaaccccggttccgttacggggttacccaaaccgggtcccccgaaaacggggtcccgttacccggacccccccgttacggggtccctaaccgtttccccg

SEQ ID NO: 431805 - DNA, 525 bp, Homo sapiens
  misc_feature: GZ8MTXP02HAVQJ.44.5.A05.1.454.CMB.2.raw
  modified_base (286)..(286): a, c, t, g, unknown or other
  modified_base (348)..(348): a, c, t, g, unknown or other
  modified_base (401)..(401): a, c, t, g, unknown or other
  modified_base (408)..(408): a, c, t, g, unknown or other
  modified_base (524)..(524): a, c, t, g, unknown or other
tcagacagtatatacacgaccggtgctcgatttagatagatagacgaggggggtctcaggaggcagcgctctcgggacgtctccaccatggcctgggctctgctattcctcaccctcctcactcagggcacagggtcctgggcccagtccgccctgactcagcctccctccgcgtccgggtctcttggacagtcagtcaccatctcctgcactggcaccagcagtgacattggtgttatactttgctctgtacacacaccagcaaacgccccaaatcatcatttangatgtcagtaagcggcctcgagggtccctgactcgcttctcgtgcctaccaagtctgcaacncggcctcctgaccgtctcgtggctccgaggctgagatgagctgacttatttcngctcctntatgtgacgaggacgtagttaggtttatcgtacgttacggaacgtcggaacctacggtcctaccgtctacgacaccgaccgaacgacccaaccgtgtactcactccgtccgtcccnc

SEQ ID NO: 431806 - DNA, 565 bp, Homo sapiens
  misc_feature: GZ8MTXP02G9MY3.44.5.A05.1.454.CMB.2.raw
tcagacagtatatacacgaccggtgctcgatttagatagatagacagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaaccagctaaatttcattggtaaatcatgactatgtctctggtaccagcatccacccaggccacacgcccccagactcgtgtattttgaggtacaaataacgccgcccctgacggggtcccgtatcggttctccgtcggcctacgaagtcgtacggacaaccgccggtccctcccgtgtacccgtctcgtcgggcctccgaggtctacggacgagtggagtctagtattatacgtgctagcgtacgagtggacgctactatgtagtttgtcgtttcggcggtacggaccagtactcgtaccgtcgtacgtcacgccgaacgtccgtccgccccgtcggtacctctcccg

SEQ ID NO: 431807 - DNA, 599 bp, Homo sapiens
  misc_feature: GZ8MTXP02HD22P.44.5.A05.1.454.CMB.2.raw
tcagacagtatatacacgaccggtgctcgatttagatagatagacagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagctaatttcattggtaaatcatgactatgtctcctggtaccagcatcacccaggcacacgcccccagactcgtgtattttgaggtcaagtaacgcccgcccctcgacggggtccccggatccgggttctccgtggcctccagtctggacaccgacggcctcccgtgacccgtctcgtcgggcctccgaggctgacgagtggagctagtattatacgtgcagtcctcgagtcgggacgcctacgtatgtactttggtcgtttcgggcggtaacgggaccctaggtaccgtacggtaacccgttccgtaacggtccgaacggaaccccgtaaacggggcccgttaccggtccccccgtcgggttaccctaccgtttccccg

SEQ ID NO: 431808 - DNA, 531 bp, Homo sapiens
  misc_feature: GZ8MTXP02JIGL1.44.5.A05.1.454.CMB.2.raw
  modified_base (278)..(278): a, c, t, g, unknown or other
tcagacagtatatacacgaccggtgctcgatttagatagatagacagggggggtctcaggaggcagcgctctcaggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacncccccaaatcatcatctatgagcctataagacgccctcaggggtttctaatcgtcttccactgcctcagtccgcacgacgcctcctgacaatctcgtcggctccaggctgaggacgaggctagattattattgttgctctagtattgtttcgtcgcattctacttatcgtcttcgggaagttgggacctaacgggtctaccgtcctaaggtccaagccccgaaaggccccaaacccgactcgtaccacttccc

SEQ ID NO: 431809 - DNA, 577 bp, Homo sapiens
  misc_feature: GZ8MTXP02JHE6R.44.5.A05.1.454.CMB.2.raw
  modified_base (220)..(220): a, c, t, g, unknown or other
tcagacagtatatacacgaccggtgctcgatttagatagatagacagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccngcaatttcattggtaatcatgactatgtctcctggtaccagcatccacccaggcacacgcccccagactcgtgtattttgaggtcaataacgcccgcccctgacggggtccgatcggttctccgtggctcagtctggcacgcggcctccctcgaccgtctcgtcgggcctccgaggctagacgtagtgacggtcttagtaatttacttactgctacgccgtccgagtcgggacgtctaaccgtattgtagtttcggtacgtttcgggacgggtacgggaccctaggacctacggtacccgtacgtacggtccaacgccgtaacggccgtccgcccccgtacggtcctacgtttcccg

SEQ ID NO: 431810 - DNA, 565 bp, Homo sapiens
  misc_feature: GZ8MTXP02GHL3V.44.5.A05.1.454.CMB.2.raw
tcagacagtatatacacgaccggtgctcgatttagatagatagacagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaatttcattggtaatcatgactatgtctctgtaccagcatcaccagcacacgccccagactcgtgtattttgagtacaataacgccgccctcgacggggtccgatcggttctcctgctcagtctggcacgcgcctcctgacctctcgtcggctccgaggctcgacgagtcgagtctagtattacttacgtcgcgacgtcgtaccgagtacgggacggtacctaccgttagtagttacgtttgtcgttttacgggcgggtacggaccgagtacgtcgaccgttccgtacggtccgacggaacccgtaacggtccgtccgtccccgtacggtccaccgtttcccg

SEQ ID NO: 431811 - DNA, 642 bp, Homo sapiens
  misc_feature: GZ8MTXP02IEUPC.44.5.A05.1.454.CMB.2.raw
  modified_base (222)..(222): a, c, t, g, unknown or other
  modified_base (250)..(250): a, c, t, g, unknown or other
tcagacagtatatacacgaccggtgctcgatttagatagatagacgaggggggggtctcaggaggcagcgctctcgggacgtctccaccatggcctgggctctgctattcctcaccctcctcactcagggcacagggtcctgggcccagtctgccctgactcagcctgcctcgtgtctggtcacctggacagtcgatcaccatctcctgctattcggaaccngcagtgactagttggtagttaataactntgtctccgtgtaccaacaacaccaggacaaacgaccccaaatcatgatcatgatgcagtaactcggccctgtacgggttctcggtcgtcttcctacgtcggcctacgaagttcgtcgggaccaaccgaccggtccctaccctcgaccctattcctccgttcgggccttaccgaggtacgtacggacggtaccggaggaccttacggtaccttacgttaaaccgtcgacccgtaaggtaccctaacgtaaacttaaaaagtaaaaacggaacgtaacgaaacttaccgtttaaagttagttaacgtttacggggacggaacgggtacgaacgtacgtacgtaccgtacgtacgacgaaccgaccgaacgcgccgtccccgtcggtactacccg

SEQ ID NO: 431812 - DNA, 629 bp, Homo sapiens
  misc_feature: GZ8MTXP02H8VZ1.44.5.A05.1.454.CMB.2.raw
tcagacagtatatacacgaccggtgctcgatttagatagatagacagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctctgcactggaacagcaatttcattggtaatctatgactatgtctcctggtacagcatccaccaggcacacgcccccagactcgtgtattttgagtcaatacgccgcccgtcgacgggtcccgtagtcggttcctcgtcgtcctacctaacgtcgtcggacaccgccgtccctcccgtcgacccgttcgtacgtcggacctccgacggcgtcgaccgagtacggacggtctaggtactttagttaacgtcgtacgtcggtacgtccgagtcgggacggtactaaccgttatacgttagtttcgttcgtttcgggacggtacgggaccgtacggtaccgtacggtaccggttacccgtacgggttaccgacggtaaccccgaacggtcccgtcccgtacccccgtccggtaccctaccgtttcccg

SEQ ID NO: 431813 - DNA, 606 bp, Homo sapiens
  misc_feature: GZ8MTXP02JRLZW.44.5.A05.1.454.CMB.2.raw
tcagacagtatatacacgaccggtgctcgatttagatagatagacgaggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgaactagttggtagtttaataactatgtctcctagtaccaaacaacaccaggacaaacgaccccaaatcatgattcatgatgtacaagtaactccggtacctgtaggggtttctggtctcttcctctggctacagtctgggccaaccgacggtccctcccgtagacctatcctcgtcgggtccgtcccgacggtcggtgacggacggacggtacgtacgtacttacttacgtcgacacgtactacaataaataaaacgaaacgaacaactactagttagtacgttacggacggacggaacgaacgtacgtacgtaccgtaccgtacgtaccgaacgaccgcgaaaaaaaaaaccgtccgtaccccgtaccgtcgtaccg

SEQ ID NO: 431814 - DNA, 485 bp, Homo sapiens
  misc_feature: GZ8MTXP02GCO7F.44.5.A05.1.454.CMB.2.raw
  modified_base (239)..(239): a, c, t, g, unknown or other
  modified_base (268)..(268): a, c, t, g, unknown or other
  modified_base (306)..(306): a, c, t, g, unknown or other
  modified_base (311)..(311): a, c, t, g, unknown or other
  modified_base (328)..(328): a, c, t, g, unknown or other
  modified_base (465)..(485): a, c, t, g, unknown or other
tcagacagtatatacacgaccggtgctcgatttagatagatagacaggggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagacgccaccagcacctggcttgacttggnggggccagggaccctggtcaccgtctccncacgccctccaccgaaggccccatccgtccttcccccnggccnccctgcctccgaggacnccacccgtccgagacgccacgacggccccgggccctggggcctcggccgttacgggtaccaacgggtaccttaccgttaccttatacttacgttgtcgtggacggtcggggtctagggaccaagggcgactagtagnnnnnnnnnnnnnnnnnnnnn

SEQ ID NO: 431815 - DNA, 644 bp, Homo sapiens
  misc_feature: GZ8MTXP02FORT8.44.5.A05.1.454.CMB.2.raw
  modified_base (248)..(248): a, c, t, g, unknown or other
  modified_base (628)..(628): a, c, t, g, unknown or other
  modified_base (637)..(638): a, c, t, g, unknown or other
  modified_base (643)..(643): a, c, t, g, unknown or other
tcagacagtatatacacgaccggtgctcgatttagatagatagacaggggggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctattggtccacgtcggcctccggggtctctgacnggttcagtgccagtgcatcacacacagtacttcacactgcacatcagcaggagtggagctaggacgtagttggttggggtactattaccgtgtacctactacctaacgtttccctaaacccgtaacccccgttctaacccggttcgggaacgtaacgggacacggtacgttagaagtaacgttaacgacgtaaacgtgggtacggcctacggtaccctaaactacgttccgttcgttaccttacgttaacctttcccgtttacccccggaccttaacgttaccgtaaggttaaccttaagttactttaacgtcggtttaaccggtacgggtaccgggtcgggtacgtacgggaacggtaacggtaccgtacgtagtacgngagcgtacnnctcang

SEQ ID NO: 431816 - DNA, 524 bp, Homo sapiens
  misc_feature: GZ8MTXP01BC354.41.12.B01.1.454.CMB.2.raw
  modified_base (262)..(262): a, c, t, g, unknown or other
  modified_base (436)..(436): a, c, t, g, unknown or other
  modified_base (475)..(475): a, c, t, g, unknown or other
  modified_base (507)..(507): a, c, t, g, unknown or other
tcagtctatactatcacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagacccctgtcccctcacctgcactgtctctggtgctccatcagcagtagtagttactactgggctgganccgcagcccccagggaagggctggagtggattgggagtatctattatagtggagcacctactacaacccgtcctcaacgagtcgagtcaccaatatcagtagacacgtccaagaaaccagttctccctgaacgctgagctctgtcgaccgccgcggacacggccgtgtattacngtgcgagagtagggctagttcgcacctaactcttgaccncgtcgggcacgggaccttggtcaccgtctccncacgtccttccgaaccg

SEQ ID NO: 431817 - DNA, 540 bp, Homo sapiens
  misc_feature: GZ8MTXP01A4V7C.41.12.B01.1.454.CMB.2.raw
  modified_base (324)..(324): a, c, t, g, unknown or other
  modified_base (406)..(406): a, c, t, g, unknown or other
  modified_base (442)..(442): a, c, t, g, unknown or other
  modified_base (521)..(521): a, c, t, g, unknown or other
tcagtctatactatcacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccacgccccccgagggaaggggctggagtggagttggggagtatctattataggtggancacctactaccaacccgtcctcaacgagtcgagtcaccaatatcagtagacacgtaccaagacagttctccctgaagctganctctgtcgaccgcgcggacacggccggtgtattacngtgcgagaggtagggctagtcgtcaactaactcttcgaccttacgtcggggcacgggacccttggtccaccggtctccncgacgtccttccgaacccg

SEQ ID NO: 431818 - DNA, 585 bp, Homo sapiens
  misc_feature: GZ8MTXP02HC3M5.41.12.B01.1.454.CMB.2.raw
  modified_base (566)..(566): a, c, t, g, unknown or other
tcagtctatactatcacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtggctccatcagcagtagtagttactacgtggggctggactccgccacgcccccgaggggaggggctggagtggagttggggagtatctattagtaggtgggagcacctactaccaacccgtccctacaacgagtcgagtcaccatactcagtagacacgtaccaaagaacctagttcctaccctagaaacgcctagacgtctctggtacgacccgccgcggaaccgccggccgttgttacttacgtggtgcgagagggtagggctaggttcgtcacctaactcgtttcgacctacggtcggggaccgacggggaaccctgggtccaccggtcctccctacncggcccctaccgaacccgg

SEQ ID NO: 431819 - DNA, 550 bp, Homo sapiens
  misc_feature: GZ8MTXP02JDYZY.41.12.B01.1.454.CMB.2.raw
tcagtctatactatcacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagtagtagttactactggggctggatccgccagcccccaggaagggctggagtggattgggagtatctattatagtgggagcacctactacaaccgtccctcaacgagtcgagtcaccatatcagtagacacgtccaagaccagttctccctgaacgctgagctctgtcgaccgccgcggacacggccgtagtatactgtgcgagagtagggcagttcgtacacctaactactttcgaaccctacgtacgggggcccaacggggaaccctcggtaaccgacccggtctacccgtacacgccctaccgaaacccg

SEQ ID NO: 431820 - DNA, 580 bp, Homo sapiens
  misc_feature: GZ8MTXP02G8EZZ.41.12.B01.1.454.CMB.2.raw
tcagtctatactatcacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactactggggctggactccgccacgcccccgagggaaggggctggagtggagttgggagtatctatataggtggagcacctactaaccaacccgtcctacaacgacgtcgagtaccaccatactcaagtagaccacgtaccaaagaacctagttcctccctagaacgctagacgctcgtcgtcgaccgccgcggaccgaccggccgtagttactacgtggtgacgagaggtagggctagttcgactaaccaacttactttcgacctacggtcgggaccgaacggggaacccctggtaacccaccgttcctcctcaccgccctaccaaacccgg

SEQ ID NO: 431821 - DNA, 541 bp, Homo sapiens
  misc_feature: GZ8MTXP02JPFXC.41.12.B01.1.454.CMB.2.raw
  modified_base (206)..(206): a, c, t, g, unknown or other
  modified_base (338)..(338): a, c, t, g, unknown or other
  modified_base (364)..(364): a, c, t, g, unknown or other
  modified_base (527)..(527): a, c, t, g, unknown or other
tcagtctatactatcacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctnacctgcactgtctctggtgctcatcagcagtagtacgttactactggggctggatccgcagcccccgagggaagggctggagtggattggggagtatctattatagtggagcacctacacaacccgtcctanaacgagtcgagtcaccatatcagtanacacgtccaaagaaccagttctccctgaaagctagagctctgtcgaccgccgcgggacaccggccgtagtacttactaggtgacgagaggtaaggggcagttcgtcaacctaactactttagacctacgtggggaccaacgggaccctagggcaccgtctccncacgcctcaacccg

SEQ ID NO: 431822 - DNA, 579 bp, Homo sapiens
  misc_feature: GZ8MTXP02HJKVO.41.12.B01.1.454.CMB.2.raw
tcagtctatactatcacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccacgcccccgagggaaggggctggagtggattgggagtatctattatagtggagcactactacaacccgtcctacaacgagtcgagtcacatatcagtagacacgtaccaagaacctagttcctcctagaacgctagagtctctgtcgaccgccgcggaccacggcctgttatacgtgtgcgagaggtagggctagtttcgacaaccgtaacttactttcggaaccctacggtcggggacccgtaacggggtaaccccgttgggtcccgtacccggtccttcccctacgtaccggtcccctacccgaaacccgg

SEQ ID NO: 431823 - DNA, 741 bp, Homo sapiens
  misc_feature: GZ8MTXP02H2L1H.41.12.B01.1.454.CMB.2.raw
  modified_base (205)..(205): a, c, t, g, unknown or other
tcagtctatactatcacgaccggtgctcgatttagtagtgtagattccgcgggggctttctgagagtcatggacctcctgtgcaagaacatgaagcacctgtggttcttcctcctgctggtggcggctccagatgggtcctgtcccagctgcagctgcaggagtcgggccaggactggtgaagccttcggagaccctgtcccctnacctgcactgtctctggtcgctccatcagcagtagtagttacacgtggggctggactccgaccacgcccccgaagggaagggctgggaggtggagttggggaagttatagttaagttaagtaggtacggggatacctaaccgtaactaaacccgtaaccccggtacctaccgaaagagttacgaacgtacaacctataacttccaaagttaagaaccgaacgttaaccaaacggaaaccctaacgtttcccttacccgtagaaacgccgttaggaacgtacttcgttaagtcggaaccccgcccggtacggaaaccgtccgggtacccgttaggtttaaccttaacgtttcgggtacggtacggtaacggtaacgggtaacgggaggtacggtttaccggttaccgaaacccgtaaaccttaaccgtttaccgttaaccgtaaccggtacggggtaccggtaaccgggaaacccgtccggtaaccgtacccggtaaccgttaccccgtaccgtaccgtacccgtacccgaacccgg

SEQ ID NO: 431824 - DNA, 612 bp, Homo sapiens
  misc_feature: GZ8MTXP02IOYPK.41.12.B01.1.454.CMB.2.raw
  modified_base (275)..(275): a, c, t, g, unknown or other
  modified_base (333)..(333): a, c, t, g, unknown or other
  modified_base (398)..(398): a, c, t, g, unknown or other
  modified_base (405)..(405): a, c, t, g, unknown or other
tcagtctatactatcacgaccggtgctcgatttagtagtgtagattccgcggggggtagctcaggaagcagagcctggagcatctccactatggcctgggctccactacttctcaccctcctcgctcactgcacaggttcttgggccaattttatgctgactccacccccctctgtgtcggagtctccggggaagacggtaaccatctcctgcacccgcagcactggcagcattgccagctaactttgtgcagtggtaccagcagccgcccgggnagtccgcccccacactgtgatctatgaggactacccaacgacccctgtcggggtcccnggtacttccggtctcgtcggcctccatcgactacgcctccctaccaactcctaccgccccctccncaacccnttctcgtgactagaagctggaaggcgaagggtctagaaccttactaacgtcgttactaggttcttaagtgtagtacgctaaagtacctaaatctagttagggttacggttaacgttccggggaacgggtaacgggaaccgtaaacgtccgtaccggtaaccgttccgtaacggtccaacggtacccgtaacggcccgttacccccgg

SEQ ID NO: 431825 - DNA, 522 bp, Homo sapiens
  misc_feature: GZ8MTXP02IKWPK.41.12.B01.1.454.CMB.2.raw
  modified_base (401)..(401): a, c, t, g, unknown or other
tcagtctatactatcacgaccggtgctcgatttagtagtgtagattccgcggggctttctgagagtcatggacctcctgtgcaagaacatgaagcacctgtggttcttcctcctgctggtgcggctcccagatggtcctgtcccagctgcagctgcaggagtcgggcccaggactggtgaagcccttcgggagaccctgtcccctcacctgccactgtctctggtgctcatcagcagtagtagttactactggggctggatccgccagcccccaggaagggctggagtggattgggagtatctattatagtggagcacctactacaacccgtcctcaacgagtcgagtcaccatatcagtagacacgtccaagaaccagttctcccagaagctgagctctntcgaccgccgcgacaccggccgtgtattactgtcgcgagagtaggctagttcgcaccgaaaactctttagaccaatcggggccaacggaccctgtcgaccgtctcctacacgcctcaaccg

SEQ ID NO: 431826 - DNA, 610 bp, Homo sapiens
  misc_feature: GZ8MTXP02F6ERF.41.12.B01.1.454.CMB.2.raw
tcagtctatactatcacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcgggagaccctgtcccctcacctgcactgtctctggtgctccatcagcagtagtagttactacgtggggctggactccgccacggcccccgaggggaacggggcgtggagtggagtggggagtatcttattagtaggtgggagcacctactaccaaccgtcctacaacgacgtcgagtcacatatcagtacgacaccgtaccaaacgacctagttcctacctagaacgtctagacgtctctggtcgaccgccgacggtaccgaccggccgttgttaattacgtggtcgacggagaggtggactaggttcgtaccaacctaaccgttacgtttacgacccgtacggtacggggaccaaccggggtaccctcggtaacccgacccgttccgtaccctccgacgtcccctacccgaaacccgg

SEQ ID NO: 431827 - DNA, 656 bp, Homo sapiens
  misc_feature: GZ8MTXP02GM18O.41.12.B01.1.454.CMB.2.raw
  modified_base (210)..(210): a, c, t, g, unknown or other
  modified_base (294)..(294): a, c, t, g, unknown or other
  modified_base (584)..(584): a, c, t, g, unknown or other
tcagtctatactatcacgaccggtgctcgatttagtagtgtagattccgcgggggctttctgagagtcatggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatcngctactgtctcgtggtacgtttccattctagttctgtatctattcgttggggctggactccggcacgccccgaggaggagtggnggtgagtgtgtacatctacttagtacgtgggtcgacgtactactcctccgtccgtcacgacgtccgtctaccgtactacgttcgtaggggacctacggtcctagtccgtaaccgtccttctaccctacgtaaaccgtcctaaccgtcccggtacgacccgccggaccggaacgtccgggttacctttagtttccgtcgtacggtcggacggtcggacgtacggttcgtttcgttactaacgtcgttacggttcggggccgttcgggacctacccggttcggtaccgttcnccggtttcctaccttcaaccgtcttacccgaccgtaaccgggccctacgttcccggtccctttaacccccgg

SEQ ID NO: 431828 - DNA, 677 bp, Homo sapiens
  misc_feature: GZ8MTXP02HVRNG.41.12.B01.1.454.CMB.2.raw
  modified_base (497)..(497): a, c, t, g, unknown or other
tcagtctatactatcacgaccggtgctcgatttagtagtgtagattccgcggggctttctgagagtcatggacctcctgtgcaagaacatgaagcacctgtggttcttcctcctgctggtggcggctccagatgggtcctgtcccagctgcagctgcaggagtcgggcccaggactgggtgaagccttcggagaccctgtcccctcacctgcacttgctctggtgctccatcagcagtagtagttactacgtggggctggactccgccacgccccagggaggctggagtgattgggatagtctattagtaggtggagctaacctactaaccgtaaccccgtccctacgaacgagtaccgagtaccaccattagtccagtaacacaaccgtaccaaacgaaacctagttacccttacccagaaacgtcctaggaacgtcctcgttgacgaccccggccgaccgacgtaacccgggccgtaacggtttatttaaccggnggtacgacggaaggtaacgggttacgggtaccgtacggtttacccgtaacctaaacccgttaaacgttaccgtttaccggaacccgtaccgggtacggggaacccgtaaccggggtaaccccgtcgggtaacccacccggttaccctcccgtaccgtacccgtaccccgtacccgaaccg

SEQ ID NO: 431829 - DNA, 578 bp, Homo sapiens
  misc_feature: GZ8MTXP01DOALQ.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagcggccaggataacctgtgagggaaataacattaggaaagtaaaagtgtgcactggtatcagcagaggccaggccaggcccctgtactggtcctctatgatgacagtggcccggccctgagggatcccgtgagcgtattctctggtccctaccaagtctgggcaacgccaaccggcccacccgtgacccatcagcgaggggtcgaaggccggggatggaggccgacttatactgtcaggtgtggtaggtttaatgtgtatcgagtcgggggtattcggggacggtagggaccgaagggtcgtaaccgtccgttacgtcacgacccgaaggttccgttcgcccccgtcgggtcctaaccgttcctccgttcccgccccgttccgtccg

SEQ ID NO: 431830 - DNA, 590 bp, Homo sapiens
  misc_feature: GZ8MTXP01CL6JZ.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggcccggccctcgagggatccctgacgcgattctcgtggcctccaagtctggcaagccaacggccaccctgaccatcagcgacggggtcgaaggccgggggatcggacggccgactattacgtgtcgaagggtgtaggtagggtttttaaataggttgaattcgaagttccgggggtattcggggcggtagggaccgtaagggtcgaaccgtccgttacggtcacggcccgaaggcgttcgcccccgttgggtcctaaccgttcttccggttcccctaacccgttcctaaccg

SEQ ID NO: 431831 - DNA, 573 bp, Homo sapiens
  misc_feature: GZ8MTXP01ANLC6.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgaagggaaataacattaggaaagtaaagtgtgcactggtatcagcagaggccaggccaggcccctgtactggtcctctatgatgacaggtcggcccggccctcgaggggactccccgtgacgcgtatttctctggccctccaagtctgggcaagccaacggcccaccctgacccatcagcagggtcgaaggccggggatggaggaccgacttattacgtgtacgagggtgtgggtaagtttaagtgtgatcaggtccggggtattcgggcggtagggaccaagggtcgaaccgtcgttacgtcacggcccaaggcgttcgcccccgtggtccaaccgtcctcgttcccctaacccgttcctcg

SEQ ID NO: 431832 - DNA, 606 bp, Homo sapiens
  misc_feature: GZ8MTXP01EASOV.9.74.G08.1.454.CMB.2.raw
  modified_base (338)..(338): a, c, t, g, unknown or other
  modified_base (364)..(364): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagcggccaggataacctgtgagggaaataacattggaagtaaaagtgtgcactggtatcagcagagcaggcaggccctgtactgtcctcatgatgacagtggccggcctcgagggatcccctgagcgattctctggcctccaagttcnggcaagcaacggccaacctgacccancagcgagggacgaacggcgggatcggacggaccgtacttattacgtgtacgtaggttgttaggttaaggttttaagtaggtagtacgtacgtacggttccgggggttagttacggggacgggtaacgggtaaccgtaacgggtcgtaacccgtccgttacgtcgaccgacccgtaaggcccgttcccgccccgttcggtcctaaccgttccgttcccggttccccgtccccgttaaccgtcg

SEQ ID NO: 431833 - DNA, 541 bp, Homo sapiens
  misc_feature: GZ8MTXP01BV6PT.9.74.G08.1.454.CMB.2.raw
  modified_base (308)..(308): a, c, t, g, unknown or other
  modified_base (354)..(354): a, c, t, g, unknown or other
  modified_base (405)..(405): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaaagtaaaagtgtgcactggtatcagcagaggccaggccaggcccctgtactggtcctctatgatgacagtggccgccctnagggatccctgacgcgtattctctggccctccaagtctggcaagcncggccaccctgaccatcagcagggtcaaggcgggatggaggccgatatacngcaggtgtggtagtttaatagtgatcagtccggggtattcgggcggtaggaccgaggtcgaacgtcttcgtcgacgtcccgaaggccgttcgccccgtcggtccaactccgtcgttccccaacccgttcctaaccg

SEQ ID NO: 431834 - DNA, 619 bp, Homo sapiens
  misc_feature: GZ8MTXP01BPQ4K.9.74.G08.1.454.CMB.2.raw
  modified_base (332)..(332): a, c, t, g, unknown or other
  modified_base (349)..(349): a, c, t, g, unknown or other
  modified_base (358)..(358): a, c, t, g, unknown or other
  modified_base (421)..(421): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccacctcggtgtcagtggccccaggaaagacggccaggataacctgtgagggaaataacattaggaaagtaaaagtgtgcactggtatcagcagaggcaggccaggccctgtactggtctctatgatgacagtcggcccggcctgaggggactcccgtgacgcgtattcnctcggccctcgaagtcnggcaagccncggcccacctgaccatcgagcgagggtacgaacggcggggatggacggccgacgttattacgngttacgaggtgtaggttaggtttaataggtgtatcgacggttccgggggtattaccggggcgggtacggggtaccaaagggtccgtaaccgggtccgttacgggtaccacggaccccgaagggttcccgttccggaccccccggttcgggtccccgtaacgttccctccggttacccctaaccccgttccctaacccg

SEQ ID NO: 431835 - DNA, 597 bp, Homo sapiens
  misc_feature: GZ8MTXP01EIAU4.9.74.G08.1.454.CMB.2.raw
  modified_base (368)..(368): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctgtgagggaaataacattaggaaagtaaaagtgtgcactggtatcagcagaggccaggccaggcccctgtactggtcctctatgatgacaggtcggcccggccctagagggactcccgtggacgcgtattctcgtggccctaccaagtctgggcacgccnccggcccacccgtgaccatcgagcgagggtcgaacggcggggatcggacggccgtatatctgtcgtaggtgtaggttaaggttttaagtaggtgactcgtaacggttccgggggtagttcggggacggtaacggggaccgtagggtcggaaccgtcgttacgtcgacgcccgaaggccgttccgccccgtcggtcctccgtccgtccggttcccctcccttcgtaaccg

SEQ ID NO: 431836 - DNA, 787 bp, Homo sapiens
  misc_feature: GZ8MTXP01CXFB2.9.74.G08.1.454.CMB.2.raw
  modified_base (292)..(292): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtccctgtgctgactcagccacctcggtgtcagtggccccaggaaagacggccaggataacctgtagaagggaaataacattaggaaagtaaaagtgtgcacgtggtatcagcgaggacggccaggccacggcccctgtactggtcctntatgatgacaggtcggccccggccctcgaacgggggtacttccccgtaggacggtcgtactttccgtcgtcggccccttaccgaaggtcgtcgggccaaacggccgaaccgggaccccaacccgttcgaacccagtcgaagggaccggaggggtacggaaacgggccgggggtatcgggaacgggaccgtaaacttagttacgtggtacgtagggttaggttagggttaaaggtttttaagtaaggttacgtaacgttaccggtaacgggttcccggggggtttaagttccggggggacggggtaaccgggggtaaaccgtaaacgggggttccggaaacccgggttacccgttaaccgggttaaccgacccgggtaacccccggaacggggttcccgttccccgggttacccccccggttccggggtttacccgtaacccgtttcccggttccccggtttaccccccttaacccccggttcccgttaacccggg

SEQ ID NO: 431837 - DNA, 704 bp, Homo sapiens
  misc_feature: GZ8MTXP01A4S2F.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctgtagagggaaataacattaggaaagtaaagtgtgcatggtatcagcagaggcaggccaggcccctgtactggtcctctatgatgacgaggtcggcccggcccctagacggggtactccccgtggacgtcgtatttccgtctcgggccccttccgaaaggtccgtgggccaacgcccgaaccgggccctaccccgtggaccccagtcgaacggcgaacgggggtaccggaacgggcccgggggagtacggaacgggacccgtaacgttattaaccgtggttacgtaagggttggttagggttaaggtttttaaagtaggttacgtagtccgtaacgggttcccggggggttagtttaccgggggacgggtaacggggaacccggtaagggtcggtaacccggttccgttacggtaccacggacccgaacgggttccgttccggcccccgttggtccctaaccgttccgtccgttccccgtcccgttccctaaccgg

SEQ ID NO: 431838 - DNA, 623 bp, Homo sapiens
  misc_feature: GZ8MTXP01B40OB.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccacctcggtgtcagtggccccaggaaagacggccaggataacctgtgagggaaataacattaggaagtaaaagtgtgcactggtatcagcagaggccaggccaggcccctgtactggtcctctatgatgacagtcggcccggcctcgagggactcccgtgagcgtattctcgtcggccctccgaagtcgtaggccaaagccaaccggcccacccgtgacccatccgagccgagggtcgaaaggccggggatggacggaccgtaacttatacgtgtcgagggttgtaggttaaggttttaataggtagagttacgaggttcccgggggtattaccgggggacggtacgggaacccgtaaagggtcgtaacccgtccgttacggtccgacgaccccgaaggcccgttccggcccccgtcgggtcctaaccttccgtcgttacccccaacccgttcctaaccg

SEQ ID NO: 431839 - DNA, 679 bp, Homo sapiens
  misc_feature: GZ8MTXP01AJKI7.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtagagggaaataacattaggaagtaaaagtgtgcactggtatcagcagaggccaggccaggcccctgtactggtcctctatgatgacgagtcgggccccggcctcgaggggactccccgtagacggcgtatttcctcgtcggccctaccgaagtccgtgggctaacgcctaaccggcccaacccgtgacccatcgaagcgacgggtacgaacggccgggggatcggaggacccgtattacgttacgtacggtcgtaagggttgttaggtaagggtttttaataagggtgtacgttacgtacggttccgggggttaacgttccggggacgggaacggggtaacctaaacggggtcggtaacccggtaccgttcggtaccgacggtaccccgaaacgggcccgttcccggccccccgtgggttcccgtaacccttcccgttcccggttcccctaaccccgttccgtaacccg

SEQ ID NO: 431840 - DNA, 582 bp, Homo sapiens
  misc_feature: GZ8MTXP01C63UO.9.74.G08.1.454.CMB.2.raw
  modified_base (282)..(282): a, c, t, g, unknown or other
  modified_base (302)..(302): a, c, t, g, unknown or other
  modified_base (322)..(322): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaaagtaaagtgtgcactggtatcagcagagcagcaggccctgtactgtcctctangatgacagtcggcccgcctnagggatccctgagcgattcnctggcctccagtcgtggcaacgcaacggccacccgtgaccatcagcgaggggtcgaaagggcccggggatggacggacccgattagtacgtgtcgagggttgtaggttaaggttttaatagtagatcgtacggtccgggggttaattcggggacggagggtaccgaagggtcgaacccggttcgttacggtcgacggcccgtaaggttccgttccgcccccgttcggactcgttcgtccgttccccgtccgttcctaacg

SEQ ID NO: 431841 - DNA, 700 bp, Homo sapiens
  misc_feature: GZ8MTXP01EPB9G.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctgtgaggaaataacagttaggaaagtaaagtgtgcactggtatcagcaggaggccaggccacggcccctgtacgtggtcctctatgatgacaggtcggcccgccctcgagggactcccgtgacgcgtattctcgtcggccctaccgaagtcgtggccaacgccgaaccggccctacccgtacgaaccctacgtacgaggacgacggggtacggaaacgggccggggagtcgggacggtaccgtacgttagttacgtaggtcgtagggttagtagggttaaagggttttaagtaggttagtacgttacggtacgggttccgggggttagttaccggggacgggtaacgggtaaccgtaaacgggtcggaacccgttccgttaccggtaccgaccggaccccggtaacgggttccccgttccggttcccccccgttcgggtaccctaacccgttcccgttcccgttacccccgtaaccccgtttcctaacccgg

SEQ ID NO: 431842 - DNA, 771 bp, Homo sapiens
  misc_feature: GZ8MTXP01BQIJP.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctgtgaggaaataacattaggaaagtaaagtgtgcactggtatcagcagaggccaggccacggcccctgtactggtcctctatgatgacaggtcggcccggccctacgagggactcccgtggacggcgtattccgtcgtggtcccctaccgaagtccgtcggccaaacggcccgaaccgggcccctaaccccgtcggacccctagtccgacgggaccgacggggttaccggaaacgggcccgggggtaagttcgggaacgggtaccccggtaacgtttaacgtttaaccgtgggttaccgtaaggggttagggttagggttaaagggttttttaaacggtaggtttacggtaacgttaccgtacggggttacccggggggttacgtttacggggggaccggggtaaacggggtaacccggtaaacggggtacccgggtaacccgggttacccgttaaccgggttaccggaccggtaccccgtaacgggttcccgttcccgggttcccccgtaacggtcccgtaacgttcccgttaccgttacccctaacccgttcccctaacgg

SEQ ID NO: 431843 - DNA, 767 bp, Homo sapiens
  misc_feature: GZ8MTXP01D3RWA.9.74.G08.1.454.CMB.2.raw
  modified_base (293)..(293): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagcccaccctcggtgtcagtcggccccaggaaagacggccaggataacctggtagaagggaaataacagttaggaaagtaaaagtgtgcacgtggtatcagcagagcaggccacggcccctgtactggtcctntatgatgacaggtcggccccggcctgacgggtactccccgtagacggctattctcgtacggcccctaccgaaggttcgtacggggccaacggacccgaacccgggaccccttaacccgtcggaaaccctatacccgaacgggtaccggaacgggggtaccgggaaacggggacccgggggtaagtacggggaaccgggtacccggtaacctttaagttaacccggtggttacgtaaggggttaggttaagggttaaaggtttttaaacgtaggttagtacgtacggtaacggggttccgggggttacgttacgggggacgggaaaccggggtaaccgtaacgggtccggtaaccccgttcgttaaccggtacgaccggacccggaacgggttcccgttccggttcccccccgttcgggtaccctaaccgtttccccgtcccggttaccccctaacccccgttccgttaacccgg

SEQ ID NO: 431844 - DNA, 673 bp, Homo sapiens
  misc_feature: GZ8MTXP01D8RUD.9.74.G08.1.454.CMB.2.raw
  modified_base (443)..(443): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtccctgtgctgactcagccaccctcggtgtcagtcggcccaggaaagacggccaggataacctgtagaagggaaataacagttaggaaagtaaaagtgtgcactggtatcagcagaggccaggccacggcccctgtactcggtcctctatgatgacgaggtcggccggcctgagggactcccgtgacgcgtattctcgtcggtcctccgaagtcgtggcaacggcaacccggcccaaccgtcgaccatcgagacgagggtacgaaggccgggatcggaacggtccgaacttagttacgnggtcgtagggttaggttaggttaaaggttttaagtaggttcgaacgttcggacgggttcgggggttaacttccgggggacggggtaacgggtaacccgtaaggggtccggaaccggtttcccgaccgggtacgaccgtaacccggaacgggttcccgttcccggacccccggttccgggtctaaccccgttccgttacccggttccccctaaccccgtttcctaacccgg

SEQ ID NO: 431845 - DNA, 767 bp, Homo sapiens
  misc_feature: GZ8MTXP01DU2HV.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctgtgagggaaataacattaggaaagtaaagtgtgcactggtatcagcagaggccaggccaggcccctgtactggtcctctatgatgacgaggtcgggccccggccctacgacgggtactccccgtgacgcgtactttcgtcgtcggcccttccgaagtccgtgggccaaccggacccgcccgggccccaaccccgttcggaacccctacgtacgacgggccgtacgggggtaccggaaacgggtcccgggggaattcgggaacgggtaccccgtaactttaacgttaaccgtggtacggtaagggttagggttacgggtttaaaggggtttttaaagtaagggttgtacgttaccggtaacgggggttaccgggggtttacgttacggggggacgggaacgggggtacccgtaaagggggtcccggtaacccggttacccgttaccggttaccgaaccgggacccccgtaaacgggccccgtttcccggccccccggttcgggtacccttccccgttccgttccccggttaccccccttaacccttccccgggttaacc

SEQ ID NO: 431846 - DNA, 666 bp, Homo sapiens
  misc_feature: GZ8MTXP01D9AG7.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctggtgaagggaaataacattaggaagtaaaagtgtgcactggtatcagcagaggccaggccaggcccctgtactggtcctctatgatgacagtcggcccggcctacgagggactccccgtgacgcgtattctcgtcggtccctaccgtaagtcgtgggccaacgccgtaaccggcccaccctgaccatcgagacgagggtacgaaacgggccggggatcggaacgggacccgtaacgttacgttaaccgtggtacgaagggttgtagggttaaggttttaagtaggttgtaagttcgaacgggttccgggggttagttacggggtacgggtaacggggtaacctaaggggtcgtaaccggtccgttaacgggtccgacggacccgaaacggccgttccggcccccgttaacgggtccctaaccgttccgtccgttacccctaaccccttcgtaacccg

SEQ ID NO: 431847 - DNA, 686 bp, Homo sapiens
  misc_feature: GZ8MTXP01C56T1.9.74.G08.1.454.CMB.2.raw
  modified_base (207)..(207): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagcggccaggataaccngtgagggaaataacattggaaagtaaagtgtgcactggtatcagcagaggcaggccaggcccctgtactggtcctctatgatgacagtcggcccggccctacgagggactccccgtgacgcgatttctcgtcgggccccttccgaaaggtcgtgggccaacgccgaaccgggcccaaccccgtggaccccatcgaacggccgacggggtacgaacgggccggggatcgggacgggaccgtacgttattaccgtggtacgagggttaggttagggttaaggtttttaaagtaggttagtacgttacgtacgggttacccgggggttagtttaccgggggacggggtaacggggtaacccgaaaggggtttcggaaccccggttccgttaaccggttcgaccgacccgaacggttaccgttccgacccccgttcgggtacctaaccgttcctccgttacccctaaccccgttcctaacccg

SEQ ID NO: 431848 - DNA, 575 bp, Homo sapiens
  misc_feature: GZ8MTXP01E14HI.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagcggccaggataacctgtgagggaaataacattaggaagtaaaagtgtgcactggtatcagcagaggccaggccaggcccctgtactggtcctctatgatgacaggtcggcccggccctcgaggggactccccgtgagcgtattctctggccctccaagtctggcaagcaaccggcccaccctgaccatcagcgagggtacgaaggccggggatggacggccgacttaattacgtgtcagggtggttggtagggttttaaataggtgtatcgaagttccgggggttattcgggacgggagggaccgagggtcgaaccgtcgttacgtcagcccgaagccgttcgccccgtggtccaacttcctcgttccccgcccgttcgtccg

SEQ ID NO: 431849 - DNA, 738 bp, Homo sapiens
  misc_feature: GZ8MTXP01CEMEN.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctgtagagggaaataacattaggaaagtaaaagtgtgcacgtggtatcagcagacggccaggccacggcccctgtacgtggtcctctatgatgacaggtcggccgccctgacgggactcccgtgacgcgtattccgtcgtacggcccctaccgaagtccgtggggaccaacgggcccgaacccgggccctaaccccgtcggaaccctacgtccgaacgggaccggtaacgggggtaccggaaacggggcccgggggtaagtacgggaaccgggacccgtaaacgtttacgttacgtacggttacgtagggttggtaaggggtttaaggtttttaaagtaggttacgtaacgttacggtacgggttaccgggggttacggttaccggggacggggtaaccggggtaacgtaacgggtcggtaacccgttacccggttacgtaccgttacggaccccgtaagggttcccgttcccggacccccgttcgggtccctaaccgttccgttccgttccccgtcccttcccgtaaccg

SEQ ID NO: 431850 - DNA, 717 bp, Homo sapiens
  misc_feature: GZ8MTXP01BHCW3.9.74.G08.1.454.CMB.2.raw
  modified_base (685)..(685): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctgtgaagggaaataacagttaggaaagtaaaagtgtgacacgtggtatcgagcaggaggccaggccacggcccctgtactggtcctctatgatgacgaggtcgggcccggtccctaggacggggtactccccgtaggaacggccgttattcctcgtcgggtacccctccgaaggtccgtggggaccaacggcccgaaccgggcccctaaaccccgtacggaacccctacgtccgaacgggaccgggtaacgggggttaccggaaacggggacccgggggactacgggacgggtaacccgtacgtttattaacgtggtacgtagggttagttaggttaagggttttaagttacggtagtacgtacggtacgggttacggggtacgttacggggacgggtaacgggacgtaacgggtcgtaacccgggttcttacggtacgaccggtaccgaacggccgttccgcccccgtggtacccncgttcctccgttacccctcccttccgtaaccg

SEQ ID NO: 431851 - DNA, 783 bp, Homo sapiens
  misc_feature: GZ8MTXP01E2J7N.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccacctcggtgtcagtggcccaggaaagacggccaggataacctgtgagggaaataacattaggaagtaaaagtgtgcactggtatcagcagaggccaggccaggcccctgtactggtcctctatgatgacaggtcggcccgccctcgagggactcccgtggacgcgatttctcgtcggcccctaccgaaggttccgtagggaccgaaacggacccgtaacccggggccccctaaaccccgttacgggaacccccgtaattcccgaaacgggacccggtaacggggggtacccggaaacggggcccggggggtaagttacggggaacgggtaccccgaaacgtttaacgtttaacccgttggtaccgtaaggggttagggttagggtttaaggggttttttaaagtacgggttagggtaacttaccggtaaggggttcccggggggttaaagtttccgggggacgggggtaacggggtaaccgtaaacggggtcgaaccccggttacgttacggtaccgaaccggtaccccgaaacgggttcccgttccgggttccccccgttcgggtccctaacccgttcccgttacccggttccccctaaccccgttcccgtaacccgg

SEQ ID NO: 431852 - DNA, 774 bp, Homo sapiens
  misc_feature: GZ8MTXP01D0GMY.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgaccgttcccctgtgctgactcacgcccacccgtcggtgtccgaggtccggacccccgaagggaaacggaccggaccgaaggtaactaaccgtggtaggaaagggtaaaataaacgtaagttaagggtaaaagtaaaagtgtacgacgtaacgtggtactcgagacgaggacggaccgacggcccgaacgggcccccttaggtaaccgttcggtcccttacgtaagtcgtagtacgacgtacggtccgggcccgtccccgtaggacgggtacctcccgtaggacgtcgttacttccgtgtcggtccctacgtaagtcgtacgccgtaacggcccaacccgggccctacccggtacgaaccgacgtacggacgggtacggacggggtacggaacgggcggggagtacgggaaccggtaccgttaagttaacgttacgtacggttacgtagggttggttaagggtttaaggttttaaagtaggttagtacgttacggtaccggttacggggtaggttacggggacgggtacgggaacgtacgggtcgtaaccgtacgttcgacgacgaccgtacgttccgttcccgcccgtcggttactaaccgttcgtacccgttcccgtccgttaaccgtaacg

SEQ ID NO: 431853 - DNA, 794 bp, Homo sapiens
  misc_feature: GZ8MTXP01CY0IL.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgaccgtcccctgtgctgactcacgcccacccgtcggtgtcagtcggaccccgaaggaaacgacggaccgaagggaactaaccgtggtaggaagggtaaaataacgtagttagggaaaagttaaaaggtgtagactaacgtggtatacgagacgaggacggccgacggcccgacggcccccttggtaccgtcggtcctactagtgatcgacgtacggtcggccccggtccgtacggacgggtacctcccgtaggacgtcgtacttccgtcgtcggtaccccctaccggtaagttcgacggccaacggacccgaacccggaccctacccgtacggaaccctagtaccggaacggccgggtaacgggggtacggaaaccgggggccgggggtaataccggggaaccgggtaccgtaacgtttacgttacgtggttacggtagggttaggttagggtttaagttttaagtaggttagtaacggttcggtaaccggggttccggggttagttacccgggggagggtaaaccgggaacggtaacgggtcgtaaccccggttacgttacggtaccgacgtaccggacggttcccgttcccggttccccgttaacgtaccctaaccgtttccgtaccccgttacccctccccgttcgtaacg

SEQ ID NO: 431854 - DNA, 539 bp, Homo sapiens
  misc_feature: GZ8MTXP02HPKK5.9.74.G08.1.454.CMB.2.raw
  modified_base (329)..(329): a, c, t, g, unknown or other
  modified_base (352)..(352): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctgtgagggaaataacattggaaagtaaagtgtgcactggtatcagcagaggccaggccaggcccctgtactggtcctctatgatgacagtggccggccctgagggatccctgagcgattcnctggccctccaagtctggcagcncggccacctgaccatcagcagggtcgaaaggccggggatggacggccgactattacgtgtacaggtgtggtagttttaatagtgatcagtccgggggtattcgggcggaggaccgaaggtcgaccgtcgtacgtcacggcccaacggctcgccccgtggtcaccttctcgttccccaccttctaccg

SEQ ID NO: 431855 - DNA, 520 bp, Homo sapiens
  misc_feature: GZ8MTXP02HTH81.9.74.G08.1.454.CMB.2.raw
  modified_base (326)..(326): a, c, t, g, unknown or other
  modified_base (348)..(348): a, c, t, g, unknown or other
  modified_base (518)..(518): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtccctgtgctgactcagccaccctcggtgtcagtggcccaggaaagacggccaggataacctgtgagggaaataacattaggaagtaaagtgtgcactggtatcagcagaggccaggccaggccctgtactggtcctctatgatgacagtggccgccctgagggactcccgtgagcgattcnctggcctccaagtctggcagcncggccacctgaccatcagcagggtcgaaggcgggatggagcgactatactgtcaggtgtggagttttaatagtcgatcagtccgggggtattcgggcggtaggaaccgaggtcgaccgtctacgtcacgacccaggctcgccctaacggtcacgtctcgtcccacttccncg

SEQ ID NO: 431856 - DNA, 524 bp, Homo sapiens
  misc_feature: GZ8MTXP02J3DYL.9.74.G08.1.454.CMB.2.raw
  modified_base (348)..(348): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaagacggccaggataacctgtgagggaaataacattggaataaaagtgtgcactggtatcagcagagccaggccaggcccctgtactggtcctctatgatgacagtggcccggccctcagggatccctgagcgattctctggcctccaagtctggcagcncggccaccctgaccatcagcagggtcgaagccggggatgaggccgactattactgtcaggtgtggtagttttatagtgatcagtccgggggtattggcggagggtaccgagtcgaccgtctacgtcagcccaacggctcgccccctcggtcacttctcgttccccgccctacctcg

SEQ ID NO: 431857 - DNA, 553 bp, Homo sapiens
  misc_feature: GZ8MTXP02JVMFQ.9.74.G08.1.454.CMB.2.raw
  modified_base (308)..(308): a, c, t, g, unknown or other
  modified_base (351)..(351): a, c, t, g, unknown or other
  modified_base (408)..(408): a, c, t, g, unknown or other
  modified_base (427)..(427): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctnagggatcccgtgagcgattctctggccctccagtctggcagcncggccacctgaccatcagcagggtcgaaaggccggggatggacggccgactattacngtcaggtgtggtagtttanagtgatcagtccgggggtattcggggcgggtagggaccgtaaagggtcgaccggtaccgtacgtcgacggcccaaggcctccggcccccgtcggtccacgtccgtcgttccccgccctccgtaccg

SEQ ID NO: 431858 - DNA, 559 bp, Homo sapiens
  misc_feature: GZ8MTXP02FU9XH.9.74.G08.1.454.CMB.2.raw
  modified_base (349)..(349): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgaatcagccaccctcggtgtcagtggccccaggaaagacggccaggataacctgtgaagggaaataacattggaaagtaaaagtgtgcactggtatcagcagagcaggcaggccctgtactggtcctctatgatgacagtggccgccctgagggatcccgtggagcgattctctggcctccgagtctggcagcncggccacctgaccatcagcagggtcgaacggccggggatggacggccgactattacgtgtcgaggtgttagggtattttaagtgttagtatcgtacggtccgggggtattcggggacgggacggaccgtaaagggtcgaacccgtcgtacgtcgacgacccgaacggcctcgcccccgtggtccacttcctccgtcccaccctcctaccg

SEQ ID NO: 431859 - DNA, 626 bp, Homo sapiens
  misc_feature: GZ8MTXP02JLKE4.9.74.G08.1.454.CMB.2.raw
  modified_base (338)..(338): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggcccaggaaagacggccaggataacctgtgaagggaaataacattaggaaagtaaaagtgtgcactggtatcagcagaggccaggccaggcccctgtactggtcctctatgatgacaggtcggcccggccctgagggactcccgtggacgcgtattcncgtggcctccaagtctggcagcacggccaccgtgaccatcagcgagggtcgaaggccggggatgggacgccgacttattacgtgtacgagggttggtaggttaagttttaagtaggttgtaagtcgtaaggtccgggggttagttcggggacgggtaacgggaaccgaaggggtcgacccggtaccgtacggaccgaacggaccccgaagggcccgttaccggccccccgttaacgggtccctacccgttccgttacccggttaccccctacccccgttcctacccgg

SEQ ID NO: 431860 - DNA, 538 bp, Homo sapiens
  misc_feature: GZ8MTXP02H6U8X.9.74.G08.1.454.CMB.2.raw
  modified_base (286)..(286): a, c, t, g, unknown or other
  modified_base (332)..(332): a, c, t, g, unknown or other
  modified_base (346)..(346): a, c, t, g, unknown or other
  modified_base (353)..(353): a, c, t, g, unknown or other
  modified_base (413)..(413): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtatcagtggccccaggaaagacggccaggataacctgtgagggaaataacattaggaaagtaaagtgtgcactggtatcagcagaggccaggccaggcccctgtactggtcctntatgatgacagtcggcccggcctcgagggctcccgtgagcgattcnctggcctccagtcnggcagcncggccacctgaccatcagcagggtcgaaggcccggggatcggaggccgtacgtattacgngtcaggtgtaggtagttttaatagtgatcgagtccggggtattcgggcggtagggacgaggtcgaccgtcgtacgtcacgccgacgcctcgccccgtcggtcacgtctacgttcccacctctacg

SEQ ID NO: 431861 - DNA, 577 bp, Homo sapiens
  misc_feature: GZ8MTXP02GUQ0R.9.74.G08.1.454.CMB.2.raw
  modified_base (353)..(353): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaaagtaaagtgtgcactggtatcagcagaggccaggccaggcccctgtactggtcctctatgatgacagtggcccggccctgagggactccctggagcgattctctggcctccaagtctggcagcnccggccaccctgaccatcagcgaggggtcgaaacggccggggagtggaacgggccgaacttagttacgtggtcgagggttggtggtaagtttaataggtgtatcgagtccggggtagttcgggcggagggaccgaaggtcgtaccgtccgtacgtcgacgacccgaacggcctccggcccccgtcggtccaccgttccgtccggttcccctacccgtcctaccg

SEQ ID NO: 431862 - DNA, 618 bp, Homo sapiens
  misc_feature: GZ8MTXP02H44MD.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattaggaaagtaaaagtgtgcactggtatcagcagaggccaggccaggcccctgtactggtcctctatgatgacagtcggcccggcctgagggactcccgtggacgcgatttccgcgtcggccctccgaagtcgtgggcaggccacgggcccaccgtcgaccatcgagcgaggggtcgaaggcccggggatcgggacggacccgtacgttacttacgtcggtcgaagggtggttagggtaagtttttaagtagttgacgttcgaggttccgggggtattcggggacgggacgggaccgtaaagggtccgaaccgtccgttacgtcgaacggacccgaacggtcctccggcccccgtggtacccacgttccgtccgttcccccgccttacccgtacg

SEQ ID NO: 431863 - DNA, 619 bp, Homo sapiens
  misc_feature: GZ8MTXP02I0CIW.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaaagtaaaagtgtgcactggtatcagcagaggcaggccaggcccctgtactggtcctctatgatgacagtcggcccggccctcgagggactcccgtgacgcgtatttccgtctcggccctaccgaagtctggcacggccaccgggcccacccgtcgaccatcgagcgaggggtacgaaggccggggatacggacggccgtacttagttaccgtggtccgaggttggtaggttaagtttaagttagtgtaagtcgtacggttaccgggggttattccggggacgggtacgggaaccgaagggtcgacccggttctaccggtcgaacggcccgtaacggccttccggcccccgtcggtccaccgttccgtaccgttcccctacccgttcctacg

SEQ ID NO: 431864 - DNA, 739 bp, Homo sapiens
  misc_feature: GZ8MTXP02HSVRR.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattaggaagtaaagtgtgcactggtatcagcagaggccaggccaggcccctgtactggtcctctatgatgacaggtcggcccggccctgagggactcccgtggacgcgtattctcgtggccctccaagtctgggcacggccgaccgggcccacccgtgaccctagtcgacgacggaggggttaccggaaacgggcccgggggaagtacgggaacgggtcccgtaacgttaagtttaaccgtggtaccgtaggggttaggttagggttaaagtttttaaagttagggttagtaacgttaccgtaacgggtttacccggggggttaagtttccgggggtacgggaaacgggggtaaacccgtaaacgggggttaccggtaaccccgggttacccgttaaccgggttaccgaaccgggacccccgaaacggggtcccgttacccggtccccccgttccggggttaccctaacccgttcccgttacccggtttccccccggcccccttttcccgtacccgg

SEQ ID NO: 431865 - DNA, 564 bp, Homo sapiens
  misc_feature: GZ8MTXP02IF849.9.74.G08.1.454.CMB.2.raw
  modified_base (275)..(275): a, c, t, g, unknown or other
  modified_base (292)..(292): a, c, t, g, unknown or other
  modified_base (329)..(329): a, c, t, g, unknown or other
  modified_base (344)..(344): a, c, t, g, unknown or other
  modified_base (351)..(351): a, c, t, g, unknown or other
  modified_base (367)..(367): a, c, t, g, unknown or other
  modified_base (388)..(388): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccacctcggtgtcagtggccccaggaagacggccaggataacctgtgagggaaataacattggaaagtaaagtgtgcactggtatcagcagaggcaggccaggcccctgtacnggtcctctatgatgacngtggcccggccctgagggatcccctggagcgattctntggcctccaagtcgngcacgcncgcccacctcgaccancgagcgagggcgaggcggganggacgcgtactatacgtgacgtggtggtaggttaagtttaagtagtacgtagtacgtacggttcggggtagtcgggacgggaggacgtaggtcgtaccgtcgtacgtcgacgaccgacggtccgtccgacccccgtcgtacctaccgttccgtcccgttacccctaccgtcctacg

SEQ ID NO: 431866 - DNA, 656 bp, Homo sapiens
  misc_feature: GZ8MTXP02FW6WU.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagcggccaggataacctgtgaagggaaataacagttaggaaagtaaagtgtgcacgtggtatcagcaggaggccaggccacggcccctgtactggtccctctatgatgacaggtcggcccgccctcgaggggactccccgtggacgcgtattcctcgtcggcccctaccgaagttcgtcggaccacggcccgaccgggcccacccgtagacccagtcgacgcgaggggtacgaaggccggggaatcggacggaccgattacttacgtggtacgagggttggtaggttaagttttaaagtagttgtagtacgtacggttaccgggggttagttccggggacgggtacggaaccggtagggtaccgtaacccggttcgtacgtacgacggacccgtaaacggccgtacccggtcccccgtcggtacctaccgttccgtcccgtttcccccggaccccttccgtaccg

SEQ ID NO: 431867 - DNA, 556 bp, Homo sapiens
  misc_feature: GZ8MTXP02GIGHP.9.74.G08.1.454.CMB.2.raw
  modified_base (354)..(354): a, c, t, g, unknown or other
  modified_base (393)..(393): a, c, t, g, unknown or other
  modified_base (522)..(522): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattaggaaagtaaaagtgtgcactggtatcagcagaggccaggccaggcccctgactggtcctctatgatgacagtcggcccgcctgagggactccctgagcgtattctcgtggccctccagtctggcagcncggccacctcgaccatcagcgaggtcgaaggccgggganggacggaccgacgtattacgtgtcgaggtggtaggtagttttaagagtgacgtcgtacggtaccgggggtagttcgggacgggagggaccgaagggtcgtaaccgtcgtacgtcgacgaccgaacgccnccgccccgcgtcacgtctcgtcccacctcctacg

SEQ ID NO: 431868 - DNA, 587 bp, Homo sapiens
  misc_feature: GZ8MTXP02JWOK4.9.74.G08.1.454.CMB.2.raw
  modified_base (364)..(364): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaaagtaaaagtgtgcactggtatcagcagaggccaggccaggcccctgtactggtcctctatgatgacaggtcggcccggccctcgaggggactccccgtgacgcgtattctcgtggccctccgaagtctggcagcnccggcccacctgaccatcagcgaggggtcgaaggccgggggatggacggccgactattacgtgtcgaggtgtaggtagtttaagtgtgatacgagttaccgggggtattcgggacgggtacgggaccgtaagggtcgtacccggtccgtacggtacgacggacccgaacggcctccggcccccgtcggtcctaccgtccgttccgtcccccgcccttccaccg

SEQ ID NO: 431869 - DNA, 684 bp, Homo sapiens
  misc_feature: GZ8MTXP02H7TSW.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcacgccacctcggtgtcagtcggcccaggaaagacgcaggataactgtgaagggaaataacattaggaaagtaaagtgtgacatggtatcagcagacggccaggccacggcccctagtactcggtcctctatgatcgacgaggtcggaccccggtccctcggacggggacttcccgtaggacgtcgtactttccgtcgtcggtccctaccgtaacgtcgtcggctaacggcccgaccgggcccctaacccgtcgaaccctataccggacggtacgaacgggggacgaacggggacccgggggagtacgggacggtaccgtaacgttacgttaacgtggttacgtagggttggttaaggtttaagtttaaagtagtaggtaacgttacggtacgggttaccgggggtacggttacggggacgggtacgggaacgtacgggtcgtaaccgtcgtacgtacgacgaccgaacggtcctccggcccctaacggtcctaccgttccgtccggtccccgtcctaccgtacg

SEQ ID NO: 431870 - DNA, 749 bp, Homo sapiens
  misc_feature: GZ8MTXP02H1QU4.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctatgacgtcccctgtgctgactcagccaccctcggtgtcagtggcccaggaaagacggccaggataacctgtagagggaaataacattaggaaagtaaagtgtgcatggtatcagcagaggccaggccaggcccctgtactggtcctctatgatgacgaggtcggcccggcctcgacggggtactcccgtggacgtcgtactttccgtcgtcggcccctcccgaaaggttccgtcggggacaacgggcccgacccggggtcccccaacccgttccggaacccctattcccggaaggacccgggaacgggggtaccggaaaacggggcccgggggtaagtacggggaaccgggtaccccgtaacgttaacgtttaacccgtgggttaccgtaggggttggttagggttaagtttttaaagttaggtagtagtccgtaggttacccgggggttatttaccgggggacggggaacgggtaccggtaaagggtaccggtaacccggttaccgtttacggaccgtaacggacccgtaaacgggtcccgtcccggtcccccggttcggtccctaaccgttcccgtaccgtttacccccctaaccctttccgtaacccg

SEQ ID NO: 431871 - DNA, 595 bp, Homo sapiens
  misc_feature: GZ8MTXP02G3R8T.9.74.G08.1.454.CMB.2.raw
  modified_base (331)..(331): a, c, t, g, unknown or other
  modified_base (347)..(347): a, c, t, g, unknown or other
  modified_base (354)..(354): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacaggtcggccggccctgagggactccctgagcgattcncgtggccctcaagtcnggcagcncggccacctgaccatcagcgagggtcgaaggccggggatggacggccgactagttacgtgtacgaggttgtagggtaagttttaagtagtagtattcgaacggttccgggggtaattcggggacggaggggaacccgtaagggtcggtaccgtccgttacggcgaacggacccgaacgggtcctccggcccccgttcgggtacctaccgttccgttccgttacccccacccgtcctacccg

SEQ ID NO: 431872 - DNA, 658 bp, Homo sapiens
  misc_feature: GZ8MTXP02HKYCR.9.74.G08.1.454.CMB.2.raw
  modified_base (332)..(332): a, c, t, g, unknown or other
  modified_base (361)..(361): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtccctgtgctgactcagccaccctcggtgtcagtggccccaggaaagcggccaggataacctgtgagggaaataacattaggaaagtaaaagtgtgcactggtatcagcagaggccaggccacggcccctgtactggtcctctatgatgacagtcggccgcctgagggactcccgtgacgcgtattcncgtggccctaccgaagtctggcacggccnccggccaacccgtgacccatcgacggcgacggggtacgaaacgggccggggagtcggacggccgtaacttagttacgtgtacgagggttgttagggttaagttttaagtaggtagtacgtacgtaacgggttccgggggttagttccgggggacgggaacggggtaaccgtaaaggggtccgtaacccggtaccgttacggaccgaaccggaccccgaacgggtcccgtacccggcccccgttcgggtaccctaacccgttccgttcccgtttacccccgaccctttcccgtaaccg

SEQ ID NO: 431873 - DNA, 604 bp, Homo sapiens
  misc_feature: GZ8MTXP02JJ6Q0.9.74.G08.1.454.CMB.2.raw
  modified_base (362)..(362): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattaggaagtaaaagtgtgcactggtatcagcagaggccaggccaggcccctgtactggtcctctatgatgacaggtcggcccggccctcgagggactccccgtggacgcgtattctcgtggccctcaagtctggcagcnccggccaccgtgaccatacagcgaaggggtcgaaggccgggatggacggaccgactagttacgtgtacgagggtgttaggtaagttttaagagtagagtacgaggttcccgggggttagttccggggacgggtaacggggtacccgtaaggggtcgtaacccggttccgtaacggtccgacggacccgaacggcccgtccgtcccccgtcggtccacctcgtccgtccccacccgtctaccg

SEQ ID NO: 431874 - DNA, 683 bp, Homo sapiens
  misc_feature: GZ8MTXP02JPNW9.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctggtgtcagtggccccaggaaagacggccaggataacctgtgaaggaaataacattaggaaagtaaaagtgtgcactggtatcagcagaggccaggccacggtcccctgtacgtggtcctctatgatgacaggtcggccggcctgagggactcccgtgagcgtacttctcgtcggccctaccgaagttctacgggacacggaccgaccgggcccctaaacccgtcgaacccagttaccgaacgtacggtaacgggggtaccggaaaacgggcccgggggtaagtacgggaaccggggtacctaaccgttagttaaccgtggtacgtaagggttgttagggttaaagttttaagtaggtacgtacgtcgtacgggttacggggtaggttcggggacgggacggtaacggtaggtccgtaaccgtaccgtacggaccgaccggacccgtacggtccctcccgcccccgtcggtaccctaccgttccgttcccgtacccctaccccgtttcgtaaccg

SEQ ID NO: 431875 - DNA, 541 bp, Homo sapiens
  misc_feature: GZ8MTXP02IYDFE.9.74.G08.1.454.CMB.2.raw
  modified_base (354)..(354): a, c, t, g, unknown or other
  modified_base (431)..(431): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaaagtaaaagtgtgcactggtatcagcagaggccaggccaggcccctgtactggtcctctatgatgacagtggcccgccctcgagggctccccgtgagcgattcgtctggcctcaagtctggcagcncggccaccctgaccatcagcgaggggtcgaaagccggggatggacgcgactatactgtacaggtgtaggtatttaangtgatcgagtccgggggtatcgggtaggacgggacgaggtcgaccgtctacgtcacgcccgaaggctcggcccccgtggtccctactccgtcgtttccccgcctactccg

SEQ ID NO: 431876 - DNA, 670 bp, Homo sapiens
  misc_feature: GZ8MTXP02GP8OM.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagcggccaggataacctgtgagggaaataacattaggaaagtaaaagtgtgcactggtatcagcagaggccaggccaggcccctgtactggtcctctatgatgacaggtcggcccggccctcgagggactccccgtgagcattctcgtggccctacccgaagtctcggcacgcgacccggcccaccctgaccccatccgaaggccgaaggggtaccgaaacgggcccgggggatagggacggacccgaacgttattaccgtgtcgaggttaggttggtaaagtttttaagtagttgtaacgttcgtaacggttccgggggtaagtttccggggacgggagggtaacccggtaaagggtccggtaacccggtaccgttaaccgggtaccaacggaccccgaacgggtcccgtaccgccccccgttaacgggtccctaaccgttccccggtccgtttcccccgtaacccttcccgtaacccg

SEQ ID NO: 431877 - DNA, 573 bp, Homo sapiens
  misc_feature: GZ8MTXP02JHN32.9.74.G08.1.454.CMB.2.raw
  modified_base (360)..(360): a, c, t, g, unknown or other
  modified_base (374)..(374): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattaggaaagtaaaagtgtgcactggtatcagcagaggccaggccaggcccctgtactggtcctctatgatgacagtggcccggccctgagggactccccgtggacgcgtattctctggccctccaagtctggcagcncggcaccctgaccntcagcgagggtcgaaggccggggatggacggccgactacttacgtgtacgaggtggtaggtagttttaagtagtgtaagtcgagttccgggggtattcggggacggagggaccgaagggtcgaccggtccgtacggtcacggtaccgaacggtcctaccgcccccgtggtccacgttcgccgtacccaccctactaccg

SEQ ID NO: 431878 - DNA, 678 bp, Homo sapiens
  misc_feature: GZ8MTXP02I4EWM.9.74.G08.1.454.CMB.2.raw
  modified_base (290)..(290): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaagacggccaggataacctgtgagggaaataacgattaggaaagtaaaagtgtgcactggtatcagcgagaggccaggccaggcccctgtactggtcctntatgatgacaggtcggcccggccctgagggactcccctggacgcgtatttcctcgtcggccctaccgaagttctgggcacgcccacgggccccacccgtgacccatcgaagccgaggggtacgaacggcccggggaagtcggaggacccgacttagttacgtgtacgagggttggttaggttaagttttaagtagttaggtacgttacgaacggttccgggggttaacgttccggggaacgggtacggggtaaccgtaaaaggggttcgtaaaacccggttccgttaaccggtaccaacggaccccgaacgggtcccgtcccggtacccccgttcgggtccctaaccgtttcccttacccgtttaccccctaccccgttccttaaccg

SEQ ID NO: 431879 - DNA, 564 bp, Homo sapiens
  misc_feature: GZ8MTXP02FWMC5.9.74.G08.1.454.CMB.2.raw
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaagacggccaggataacctgtgagggaaataacattggaagtaaaagtgtgcactggtatcagcagaggccaggccaggcccctgtactggtcctctatgatgacagtcggccggccctgagggctccctgacgcgtattcgtctggccctaccgaagtctggcacgcacggccacctgacccatcagcgagggtacgaacggccgggaatggacggaccgactattacgtgtacgtaggttaggtggtaagtttaagtgtagtacgtcgaaggtcgggggttatcgggacggacgggtacgaggtacgaccggttctacgtacgacgtccgaacggcctcgccccgtggtccactcgtccgtcccgcccttcacg

SEQ ID NO: 431880 - DNA, 632 bp, Homo sapiens
  misc_feature: GZ8MTXP02GVGT8.9.74.G08.1.454.CMB.2.raw
  modified_base (350)..(350): a, c, t, g, unknown or other
  modified_base (376)..(376): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtcggccccaggaaacgacggccaggataacctgtagaagggaaataacagttaggaaagtaaaagtgtgacacgtggtatcgagcagaggccaggccaggcccctgtactggtcctctatgatcgactaggtcggcccgccctgacgggtactccccgtagacgcgtattcncgtggccctaccgagtctggcagccncggcccacctgacccatcacgacgaggggtacgaacgggccgggatcggacggtaccgtacttagttacgtgtacgagggttgtaggttaattttaagacgttgtagtcgtaacgggttccgggggtaagttcggggacgggagggaccgtaagggtccgtaaccgtccgtaaacggtccacggacccgaacgggtcctacccggtcccccgtcggtacccaccgttcctccggttcccccaccgttcctacccgg

SEQ ID NO: 431881 - DNA, 738 bp, Homo sapiens
  misc_feature: GZ8MTXP02FKEYX.9.74.G08.1.454.CMB.2.raw
  modified_base (256)..(256): a, c, t, g, unknown or other
tcagtgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtccctgtgctgactcagccaccctcggtgtcagtcggccccaaggaaagacggccaggataacctgtgagggaaataacattggaaagtaaagtgtgcatggtatcagcagnggcaggccaggcccctgtactcggtcctctatgatgacaggtcggcccggccctacgaggggactccccgtgacggtcgtaattcgtcgttcggcccttacccgtaaagtcgtcgggcacggccgacccggggccccaaccccttcgggaacccccttaaagtccgaacggggacccgggtaaacgggggttccgggaaaaccgggggtcccggggggaagttacggggaacgggggtaccccgaaacgtttaaacgtttaaacccggttggtaccgtaagggggtttagggttagggggttaaagttttttaaaggtaacggtaggttaagtacggtaacgggttcccggggggttaagtttccgggggacgggtaacggggaaccgtaagggtaccgtaccgtaccgtacgtacgacggacccgaacggcctcccgaccccgtcggtaccacgtcccttacgttccccaccctcctaccg

SEQ ID NO: 431882 - DNA, 544 bp, Homo sapiens
  misc_feature: GZ8MTXP01DCMZR.11.31.C09.1.454.CMB.2.raw
  modified_base (297)..(297): a, c, t, g, unknown or other
  modified_base (364)..(364): a, c, t, g, unknown or other
  modified_base (390)..(390): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagaggccaccatcaactgcaaggcaagccagatttattttatacagctccgacagtaagactacttatcttggtccaaacagaaacccaggacagcctacctaaattactctatttatccanatctatcggcggccgtccggggtccccacgattcagtggcagcggtctgggacagatttcactctcncaatcagcagcctgcagactgaaagntgtggtacttattatgtacaacaattattcttacgtttgtttcccgtttaatttcggacggtagggacctaaggtacggagtatcgtaaaacgactgtcggactggcctacctaattcgttgttccttcattccttcccgcattccttgtaacg

SEQ ID NO: 431883 - DNA, 533 bp, Homo sapiens
  misc_feature: GZ8MTXP01BK8ND.11.31.C09.1.454.CMB.2.raw
  modified_base (320)..(320): a, c, t, g, unknown or other
  modified_base (506)..(506): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggtccaacagaaaccaggacagcctcctaaatactcatttatccacatctatgcggcctccggggtccccacgnttcagtgcagcggtctgggacagatttcactctcaacaatcagcagcctgcagactgaagatgtgggtcgttttattattgtacaaactaattatttcttcgtttgtttcccggttttaaatttcgggcggtaaggggtacccaaagggttggagtatacaaacgaactggtggctgcaccattcngttcttcatccttcccgcatcttgtaa

SEQ ID NO: 431884 - DNA, 627 bp, Homo sapiens
  misc_feature: GZ8MTXP01D4SUI.11.31.C09.1.454.CMB.2.raw
  modified_base (220)..(220): a, c, t, g, unknown or other
  modified_base (231)..(231): a, c, t, g, unknown or other
  modified_base (250)..(250): a, c, t, g, unknown or other
  modified_base (259)..(259): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacanctcacagtaanaactatatcttgtacacanaacagacanactactaatactactattatacacatctatcgcggccgtcccgggtccccggtaccgtacttcgtacgtcggcgacggcggtcgtcggacgagtacttctactactacaacaactacacgacgacgactcgacacgacgtagaagtagtaggttagggttacgtttagtttatttagttaactaaactaaattaactttactttacgtttacgttttacgttttaacgtttacgggttacgggtaacgggtaaccggtaacggtaaggtaagtaacgtaacgtaaacgtaacgtaaggtacggttcgtcgttacgtacctacttcgttcgttcttctacttccttcccgtaccttactcgttcgtaag

SEQ ID NO: 431885 - DNA, 533 bp, Homo sapiens
  misc_feature: GZ8MTXP01DQ2CN.11.31.C09.1.454.CMB.2.raw
  modified_base (391)..(391): a, c, t, g, unknown or other
  modified_base (418)..(418): a, c, t, g, unknown or other
  modified_base (472)..(472): a, c, t, g, unknown or other
  modified_base (503)..(503): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctcgacagtaagaactacttatcttgtaccaacagaaaccaggacagcctactaaatactctatttatccacatctatgccggcctcccggggtccccacgtattcaggtggcaggcggtctcgggacagtatttcactctacaacaatcagcagcctgcagactagaagntggtgggtactttatatgacaatattnttctcgtttgttccgtttaatcgggacgtaggacaagggtgatatacgaaacgntgtacggctgacctactagttcttgttcctntactcccttcccgcttattccgttggtaac

SEQ ID NO: 431886 - DNA, 589 bp, Homo sapiens
  misc_feature: GZ8MTXP01BVD9X.11.31.C09.1.454.CMB.2.raw
  modified_base (218)..(218): a, c, t, g, unknown or other
  modified_base (397)..(397): a, c, t, g, unknown or other
  modified_base (436)..(436): a, c, t, g, unknown or other
  modified_base (523)..(523): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtattattttanacagctccgacagtaagaactacttatcttgtaccaacagaaacaggacagcctactaaatactctatttactccactatctatggcgggcccgtcccgggggtccccgacgtattcgagtgcaggcgggtctgggacagtattcactctcaacatcagcacgcctgcagactgaaagngtggtagggtacgttttaattagtcgtacaaattaattntttccttcggtttacgttttacccgtttaaagtttccggggaacggtaacggaccgtaagggttggaacgtatacgaaaaccgtagnggtaggctacgcaacccgtagttcttcgttcttccattcccgttcccgcttagttccgttggtaac

SEQ ID NO: 431887 - DNA, 657 bp, Homo sapiens
  misc_feature: GZ8MTXP01CE43V.11.31.C09.1.454.CMB.2.raw
  modified_base (224)..(224): a, c, t, g, unknown or other
  modified_base (242)..(242): a, c, t, g, unknown or other
  modified_base (303)..(303): a, c, t, g, unknown or other
  modified_base (608)..(608): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctcgtgggcgaggacgggccaccatacaactgacgaaggcaagccagtatttatttanacagctacgacaagtaanaactattatcgttcgtaccaacacgaaacaggacacgcctactaaatctctatttactcanatctagcggccggtcccgtccgggtaccccgacgtattcgagtcggcgacggtcgggtcgtacgggactagtactttcactcctacaacatcagcagcctgacagtacgtagaaagtgttgggttacgggttactttttaattcgttacgtaaacctaaaactaaagtttccttttccgtttacggtttttacgggttttaaccccggtttttaaaggttccgggggaacggggaacggtaaccgtaaggggttagggaataactaacgaaaacgtagttggtgggccttacgcctaaaccgttntttccgttcgttacctctactttccccgtccacttattccgttgtaacg

SEQ ID NO: 431888 - DNA, 691 bp, Homo sapiens
  misc_feature: GZ8MTXP01DPBHT.11.31.C09.1.454.CMB.2.raw
  modified_base (255)..(255): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagatttatttatacagctccgacagtaagaactattatcttggtaccaanagaaaccaggacagccctactaaattactctatttatccacatctatcggccggcctccggggtccccacgattcaggtgcaggcggtctcgggacagtatttcactctacaacaatcagcacgcctgacagactaggaagtatgggttagggtacttttaattacgttagtaaccaaaactaaattctttcccgttcgtttttacggtttttaaccccggtttttaaaggtttccgggggaccggggtaaaggggtaacccgttaaagggggttacgggaaagtaaacgttaaccggaaaaacccggtaaggttgggttacggggcccttaaggacccctaaaccccgttaagttccctttcgggtttcccctttaacctaacgttttccccctttacccccccggaccttaattcccgtttaaggggttaaacc

SEQ ID NO: 431889 - DNA, 622 bp, Homo sapiens
  misc_feature: GZ8MTXP01AI9C8.11.31.C09.1.454.CMB.2.raw
  modified_base (405)..(405): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagatttatttatacagctccgacagtaagaactacttatcttggtaccaacagaaaccaggacacgcctacctaaattactcatttactccacatctatggccggcccgtcccgggggtccccgaccgtattcgaggtggcaggcgggtctggggacagtatttcactctcaacaatcagcagcctgcagactagaagtntggtgggtacttttattattgaacaactaattactttcttcggtttagtttacccgttttaaagttccggggacgggtaagggtacccgaaggggttggaacgtacgttaaccgaaaaccggtagttggtcgggaccttcggaccctaaacccgtattccgttcggttacctttaacactttccccgttccccgacttactttccgttggttaaccg

SEQ ID NO: 431890 - DNA, 640 bp, Homo sapiens
  misc_feature: GZ8MTXP01ECKD1.11.31.C09.1.454.CMB.2.raw
  modified_base (220)..(220): a, c, t, g, unknown or other
  modified_base (230)..(230): a, c, t, g, unknown or other
  modified_base (236)..(236): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatgacccagtctccagtacttcctatttgtatctctgggcgagagggccaccatcaactgcaaggcaagccagtatttatttanacagctcganagtaanaactattatcttgtacaacagaaaccagacagcctactaaattactctatttactccatatctatgccgggcctcccggggccccacgtctcgagtggcaggcggtctcgggacagtatttcactctcaacatcagcagcctgacatactagaaagtgttggttggggttacttttaaattagttcgtaaaccaaaacttaaattacttttcctttacggttttacgttttaaccccggtttttaaagtttcccggggagggtaaacgggtaaaccctaaagggggttggaaataaagttaaacccgaaaacgggttaactggggttcggccttacgaaccaacccgttagtttcttcggtttacccttcacttcccttcccccgattacttcgttaagtaacg

SEQ ID NO: 431891 - DNA, 604 bp, Homo sapiens
  misc_feature: GZ8MTXP01DNZ7L.11.31.C09.1.454.CMB.2.raw
  modified_base (217)..(217): a, c, t, g, unknown or other
  modified_base (234)..(234): a, c, t, g, unknown or other
  modified_base (263)..(263): a, c, t, g, unknown or other
  modified_base (360)..(360): a, c, t, g, unknown or other
  modified_base (386)..(386): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtattatttanacagctccgacagtaanaactacttatcttggtccaacagaaaccnggacagcctacctaaattactctatttatccacatctatgcgggcctccggggccccacgattcagtggcagcgggtctgggacagatttcactctnaacatcagcagcctgcagactgaagntgtgggtactttattattgtacaaactaattattccgttatttgtttacccggttttaaatttccggggacggtaggggtaaccaaagggtaggtaagtaataccgaaaaccgtaacgtggtcgggttcttacggaccgaaccctaagttccgttcggtttccctttccaaactttccccggttttaaccccccgaccgttacttccgttaagtaacg

SEQ ID NO: 431892 - DNA, 630 bp, Homo sapiens
  misc_feature: GZ8MTXP01ETBWD.11.31.C09.1.454.CMB.2.raw
  modified_base (219)..(219): a, c, t, g, unknown or other
  modified_base (302)..(302): a, c, t, g, unknown or other
  modified_base (612)..(612): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtatttattttanacagctaccgacagtaaagaactacttatcttggtaccaacagaaaccaggacacgcctacctaaatactctatttactccanatctatcggccggcccgttcccgggggtcccccgacgtactttcgaggtcggcacggcgggtctaggggacagtatttcactcctacaacaaatcagtcacgcctagaccaaggtactaggaaagtgttgggttaggttacgttttatttacgtgtaaccaaataattctttcgttcgtttgttttacccgtttaaagttccgggacggtagggaaccgtagggtgaagaacttacgaaaaccgtagttggtggcctggaccaaccttaagttccgttggttccctttaaccacttccccttacccccgnttacttcgttaagtaacg

SEQ ID NO: 431893 - DNA, 696 bp, Homo sapiens
  misc_feature: GZ8MTXP01C5W0T.11.31.C09.1.454.CMB.2.raw
  modified_base (220)..(220): a, c, t, g, unknown or other
  modified_base (231)..(231): a, c, t, g, unknown or other
  modified_base (237)..(237): a, c, t, g, unknown or other
tcagcgagagataccacgaccggtgctcgatttagacgtctcatcaaggaaggaagggggcagcaagatggtgttgcagacccaggtcttcatttctctgttgctctggatctctggtgccaacggggacatcgtgatgacccagtctccagacttcctatttgtatctcgtgggcgagagggccaccatcaactgcaaggcaagccagtatttatttanacagctccganagtaanaactacttatcttgtaccaacagaacaggacagcctactaaatactctatttactcacatctatcggccggcccgtcccggggtaccccgaccgtattcgaggtggcgaggcgggtcgtcgggactagtatttccactacctacaacaatcaagacgcctgacaagtactagaagtagttgggtagggttacgttttaatttacgtttagtaaccaaacttaaattactttacctttcgttttacggggtttttaccccgggtttttaaaggtttccgggggtaccgggggaaagggtaaccccggtaaagggggttagggaaacgtaagttaaacccggtaaaacgacggtttagggtcggtccgttacggacccaacccgtattcccgtttcgttcttttacccgtcctttccccgtttcccccggaccttactttaccgtaaggttaacgtttccc

SEQ ID NO: 431894 - DNA, 639 bp, Homo sapiens
  misc_feature: GZ8MTXP01AZ4X8.11.31.C09.1.454.CMB.2.raw
  modified_base (455)..(455): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtatttattttatacagctccgacagtaagaactacttatcttggttaccaacagaaaccaggacagcctactaaattactactatttactccactatctagtcggccggggtccccgtccccgggggtcccccgaccgtatttcaggtggcgaggcgggtctcggggacagtatttcactctcaacatcagcagcctgcagactaggaagtagtggttgggtacttttattattgtacaaactaattntttcttcggtttagtttaccgttttaagttccggggacgggtaacgggtaccgtaaaggggttggaacgttactaaaccgtaaacggacgttgggtgggttacctcggaccgtaaaccctagttccttcggttcccttaaccgtactttcccccgttcccggacccttagttcgttcggttaac

SEQ ID NO: 431895 - DNA, 730 bp, Homo sapiens
  misc_feature: GZ8MTXP01BX39Q.11.31.C09.1.454.CMB.2.raw
  modified_base (233)..(233): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatgacccagtctccagacttcctatttgtatctcgtgggcgagagggccaccatcaactgacaaggcaagccagtatttatttatacagctaccganagtaaagaactacttatcttggtaccaacagaaaccaggacagcctactaaatactactatttactccactatctagtcggccgggcccgtccccgggggtaccccgacgtacttcgaggtggcgaggcgggtcgtacgggactagtactttccactctacaacaactcagccacgtcctgacaagtacgtaggaaagtgttgggttaggggtttacttttaagtttagttcgtaacaaacttaattacttttccgtttacggttttacggtttttaacccggttttaaagttcccgggggaacggggtaacgggtaacccgtaaaggggttacggtaaagtaaccgttaaaccggtaaaaccggtaacggttcgggttcgggttaccttaccgggaaccctaaccccggtaattttcccgtttcgtttacccctttccgtaacccttttccccgtttacccccgacgtttaacttcccggtttaaggtttaacccg

SEQ ID NO: 431896 - DNA, 586 bp, Homo sapiens
  misc_feature: GZ8MTXP01CHJOU.11.31.C09.1.454.CMB.2.raw
  modified_base (222)..(222): a, c, t, g, unknown or other
  modified_base (233)..(233): a, c, t, g, unknown or other
  modified_base (239)..(239): a, c, t, g, unknown or other
  modified_base (246)..(246): a, c, t, g, unknown or other
  modified_base (266)..(266): a, c, t, g, unknown or other
  modified_base (298)..(298): a, c, t, g, unknown or other
  modified_base (353)..(353): a, c, t, g, unknown or other
  modified_base (415)..(415): a, c, t, g, unknown or other
  modified_base (482)..(482): a, c, t, g, unknown or other
  modified_base (568)..(568): a, c, t, g, unknown or other
  modified_base (581)..(581): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatgacccagtctccagacttcctatttgtatctcgtgggcgaggacgggccaccatcaactgacaaggcaagccagtattatttanacagctccganagtaanaactatntcttgtaccaacagaaaccnggacagcctactaaattctctatttactccanatctatcggcgggcccctcccgggggtccccacgtattcaggtggcaggcgggtntcggggacagtatttccacttcctacaacgaatccaggtcacgcctgactacgataggaagngttggtgggtacttttattatgtaacaactaattacttcttacgtttgtttacctttagttccgggnggtaacgggacctaagggtcggaagtactacgaaagtcggtgtcggctgaactcctattcgctttctaacgtattcccgttacccncttagttccgttntaacg

SEQ ID NO: 431897 - DNA, 623 bp, Homo sapiens
  misc_feature: GZ8MTXP01D50VP.11.31.C09.1.454.CMB.2.raw
  modified_base (283)..(283): a, c, t, g, unknown or other
  modified_base (294)..(294): a, c, t, g, unknown or other
  modified_base (547)..(547): a, c, t, g, unknown or other
  modified_base (561)..(561): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatgacccagtctccagacttcctatttgtatctcgtgggcgagagggccaccatcaactgcgaaggcaagccaagtatttatttatacagctaccgacagtaagaactatatcttgtacaacagaacagacacgctactaattactntattactccanatctatcggccgggtcccgtcccgggtccccgtacgactttcgagtggcgaggcggtacgtcggactaagtacttacactactacaacaatcagcacgcctagacctagacgtaggtaaatggttcgggtaggggtttaactttttaattacgtttacgactaaaacgtattttactttccttggttttacggtttaacgttttaagtcggggacggtaacgggaacgtaagggacgagtacaacgtaaacgntaaggtcgttcganaccgaactgttacttcgttcctaacctcttccccgttcccggacttacgttcgttaagtaac

SEQ ID NO: 431898 - DNA, 610 bp, Homo sapiens
  misc_feature: GZ8MTXP01B6JSE.11.31.C09.1.454.CMB.2.raw
  modified_base (217)..(217): a, c, t, g, unknown or other
  modified_base (234)..(234): a, c, t, g, unknown or other
  modified_base (294)..(294): a, c, t, g, unknown or other
  modified_base (412)..(412): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagatttatttanacagctccgacagtaanaactacttatcttgtccaacagaaaccaggacagcctactaaattactctatttatccanactctatgcggcctccggggtccccacgattcagtggcaggcggtctgggacagatttcactctcaacaatcagcagcctgcagactagaagatggtagggtacgttttatattcganaaactaattatttccttacggtttgttttacccggttttaaagtttccggggacgggtaagggtaaccctaaagggtggaataataaccgaaaacggaacgttgggtcgggacttacggaccaaacccgttgtttacccgttgtttacccttaacctaccgttccccgttccccgaccttacttccgttaaggtaacg

SEQ ID NO: 431899 - DNA, 654 bp, Homo sapiens
  misc_feature: GZ8MTXP01BPHTM.11.31.C09.1.454.CMB.2.raw
tcagcgagagataccacgaccggtgctcgatttagacgtctcatcaaggaaggaaggggcagcaagatggtgttgcagacccaggtcttcatttctctgttgctctggatctctggtgccaacgggacatcgtgatgacccagtctccagacttcctatttgtatctcgtgggcgagacgggccaccatcaactgacaaggcaagccagtatttatttatacagctaccgacagtaagtaacttacttatcttggtaccaacaagaaaccagacagacctacttaaatactctaatttactaccatatctatcggccggtcccgtcccgggggtaccccgtaccgtactttcgaggttcggcgtacgggccgggtcgtacgggggactagtactttccacctctacaacgactacacgaccacgcctgacgagtactaggtaagagttcgggtagggtttacttttattaatttcgaacaaacttaattactttcgttccggtttagtttaccgttttaagttcggggacgggtacggaaccgtagggtagataacggtacaaacggtcgtaaggtcggacttacggcctaaccgttattcgttttacgttcctttcaccttccttaccccggcttagttcgttaaggtaaccg

SEQ ID NO: 431900 - DNA, 516 bp, Homo sapiens
  misc_feature: GZ8MTXP02FWTVE.11.31.C09.1.454.CMB.2.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctcctaaattactcatttatccacatctatgcggcctccggggtccccgaccgattcagtggcagcggtctgggacagatttcactctcacaatcagcagcctgcagactgaaagatggtgggtctttattattgtcaaacaattattctctttgtttccgtttaaatttcgggcggtaagggaccaagggtggaagatacaaaacgactgtggctgcacatctgtctcatctcccgcatctgtac

SEQ ID NO: 431901 - DNA, 529 bp, Homo sapiens
  misc_feature: GZ8MTXP02ISPIN.11.31.C09.1.454.CMB.2.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctacctaaattactcatttatccacatctatgcggcctccggggtccccacgattcagtggcagcggtctgggacagatttcactctcacaatcagcagcctgcagactgaagatggtggggtcttttattattgtcaaacaattatttcttcttgtttccgtttaaatttcgggacggagggacctaaagggtggaagtatacgaaaacgactggtggactgacactatctgtcttcactccttcccgctactctgta

SEQ ID NO: 431902 - DNA, 584 bp, Homo sapiens
  misc_feature: GZ8MTXP02HD04Y.11.31.C09.1.454.CMB.2.raw
  modified_base (294)..(294): a, c, t, g, unknown or other
  modified_base (386)..(386): a, c, t, g, unknown or other
  modified_base (414)..(414): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctcgacagtaagaactacttatcttggttccaacagaaaccaggacagcctacctaaattactcatttatccanatctatgcggcctccggggtccccacgattcagtggcaggcggtctcgggacagatttcactctcacaatcagcagcctgcagactgaaagngtggtggtatttatattgacaataattnttcttcgtttacgtttaccgtttaagttccggggaggtaacggtaacgtaagggtagaacgtaactaacgaaaacgtaacgttggtacggtcctacgacctaacctacttaccgttcgttaccttaaccgtactttccccgttaccccgacttacgttcgttacggaacg

SEQ ID NO: 431903 - DNA, 571 bp, Homo sapiens
  misc_feature: GZ8MTXP02HPU77.11.31.C09.1.454.CMB.2.raw
  modified_base (359)..(359): a, c, t, g, unknown or other
tcagcgagagataccacgaccggtgctcgatttagacgtctcatcaaggaaggaagggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctacctaaaattactcatttattccacatctatgcgggcctccggggtccccgacgattcagtgcagcggtctgggacagatttcactcnacaatcagcagctcgcagactgaagaatgtggtcggtttatttattagtactaaactaaataattacttctttcgtttaccgttttaagtttacggttaccgggtaggggaaccgaaacggtagggaggaagtaacgaaaacgaaacgtacgtacggcgtcgtacacactactcttcttctactaccttacccgtacctactactacgtacg

SEQ ID NO: 431904 - DNA, 606 bp, Homo sapiens
  misc_feature: GZ8MTXP02HGCAY.11.31.C09.1.454.CMB.2.raw
  modified_base (294)..(294): a, c, t, g, unknown or other
  modified_base (346)..(346): a, c, t, g, unknown or other
  modified_base (387)..(387): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctacctaaatactcattatccanatctatgcggcctccggggtccccacgattcagtgcaggcgggtctgggacngtatttcactctcacaatcagcagcctgcagactagaaagngtggtgggtcgttttatattagtactaaactaattactttctttacgtttagttttacccgttttaaagtttcggggaaccggtaagggtaacccgtaaaggggttggtaaggtaattaaccgaaaaacgtaaacgttgtaacggtactacggctaaccctagttcccgttgttacctttaacgacttccctttccccgacttaactcctaggttaacg

SEQ ID NO: 431905 - DNA, 661 bp, Homo sapiens
  misc_feature: GZ8MTXP02G8LKX.11.31.C09.1.454.CMB.2.raw
  modified_base (296)..(296): a, c, t, g, unknown or other
  modified_base (366)..(366): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctcctaaaattactctatttatccanatctatgcggcctccggggtccccgacggttcagtgcagcggtctggaccagtattcactctcacatcancagcctgcagactgaaagatggtgggtcgttttaattagttagtaccaaaactaaattactttccttcgttttagtttaccccgtttttaaaagtttcccggggacgggtaaacggggtaaccctaaaagggggttcggaaaggtaaacttaacccgaaaaaacgggtaaaccgttcgggttaacggggcccttagggaccctaaacccctaaggtttccctacggttccctttaccgaacctttccccgtttaccccccgactaaacgtttcccttacgggtaagttttaaccc

SEQ ID NO: 431906 - DNA, 557 bp, Homo sapiens
  misc_feature: GZ8MTXP02GPKU1.11.31.C09.1.454.CMB.2.raw
  modified_base (228)..(228): a, c, t, g, unknown or other
  modified_base (323)..(323): a, c, t, g, unknown or other
  modified_base (341)..(341): a, c, t, g, unknown or other
  modified_base (382)..(382): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccganagtaagaactacttatcttggtccaacagaaaccaggacagcctacctaaattactcatttatccacatctatgcggcctccggggtccccacgnttcagtggcagcgggtcngggacagtatttcactctcacatcagcagctgcagctaganatggtgggtctttattatgtacaaactaattatttctactttgtttaccgtttaaagtttcgggacgggtaagggacctaagggtggaacgataccgaaaacgtaacgttggtacggactcgacctaaccattcgtgttaccttctactccctttaccccgctactcctaggtac

SEQ ID NO: 431907 - DNA, 606 bp, Homo sapiens
  misc_feature: GZ8MTXP02JT3NO.11.31.C09.1.454.CMB.2.raw
  modified_base (216)..(216): a, c, t, g, unknown or other
  modified_base (296)..(296): a, c, t, g, unknown or other
  modified_base (341)..(341): a, c, t, g, unknown or other
  modified_base (390)..(390): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttanacagctccgacagtaagaactacttatcttggttccaacagaaaccaggacagcctacctaaattactctatttatccanatctatgcggcctccggggtccccacgattcagtggcaggcggtntcggggacagtatttcactctcacaatcagcagcctgcagactagaagngtggtgggtctttatattgtacaaactaattacttcttactttcggtttaccgttttaaagtttccggggaacgggtagggtaacccgaaggggttggaacgtactaacgaaaacggtaaccgtttggtacggtacttcggacctaaccgtacgttccttcggttacctttaaccgactttcccgtttacccccgactactttccgtaggttaacg

SEQ ID NO: 431908 - DNA, 575 bp, Homo sapiens
  misc_feature: GZ8MTXP02FRB1B.11.31.C09.1.454.CMB.2.raw
  modified_base (387)..(387): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacgggacatcgtgatgacccagtctccagacttcctatttgtatctctgggcgagagggccaccatcaactgcaaggcaagccagattatttatacagctccgacagtaagaactacttatcttgtccaacagaaaccaggacagcctacctaaattactcatttatcactatctatgcggcctccggggtccccgacgactcagtggcagcggatccgtgggacagtatttcactctcacaatcagcagcctgacagactgaaantaggtggacgttttatagttgacaactaaattatttcttactttgtttaccttttaaaggttcggacggtagggtaaccgaagggttggaagtactacgaaaacgtaacgttggtacggactaggaccctaacctacgtcttacggttccttctaacgttcccctttccccgactactttccgtaagg

SEQ ID NO: 431909 - DNA, 531 bp, Homo sapiens
  misc_feature: GZ8MTXP02HG9LX.11.31.C09.1.454.CMB.2.raw
  modified_base (296)..(296): a, c, t, g, unknown or other
  modified_base (511)..(511): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccanatctatgcggcctccggggtccccaccgattcagtggcagcgggtctgggacagtatttcactctcacaatcagcagcctgcagactgaagatgtgggtctttatattgtacaactaatattctctttgtttccgtttaaatttcgggacggtagggaacctaagggttggaagattacaaaacgtacgtgtaggctcgacacctatctagtctnactcttcccgcatcctgtac

SEQ ID NO: 431910 - DNA, 560 bp, Homo sapiens
  misc_feature: GZ8MTXP02G3YXR.11.31.C09.1.454.CMB.2.raw
  modified_base (295)..(295): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctactaaattactctatttatccanatctatgcggccctccggggtccccacgattcagtggcaggcgggtctggggacagtatttcactctcacaatcagcagcctgccagactagaagagtggtgggtacttttatattgtacaaactaattacttctttcttagttttcccgtttaaatttccggggagtaacggggtaccaagggtgaacgattacgaaaacgtacttggcggtctcgccacctagtcctgttcttcgacttcccgttacccactactctagtacg

SEQ ID NO: 431911 - DNA, 666 bp, Homo sapiens
  misc_feature: GZ8MTXP02JBW3N.11.31.C09.1.454.CMB.2.raw
  modified_base (228)..(228): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagatttatttatacagctccganagtaagaactacttatcttggtccaacagaaaccaggacagcctactaaattctctatttatccatatctatcggccggccctccggggccccgacgattcgagtggcaggcgggtctgggacagtactttcactctcactaatcagccagccctgccaagactagaaagagtggttaggggtacttttagttattaggtaccaaaataatttaatttcctttacgtttacgttttacccgtttttaaagtttccggggacgggtaaacggggtaacctaaagggggtgggtaaagtaacgttaaccgaaaaaacgtaacgttgggtacgggtaccttacgggacctaaacccgtagtttccccgtttggttaccctttaaccgtaaccgtttcccctttcccccggaaccccttaatttcccgttaaggttaaaccg

SEQ ID NO: 431912 - DNA, 578 bp, Homo sapiens
  misc_feature: GZ8MTXP02F6LE7.11.31.C09.1.454.CMB.2.raw
  modified_base (217)..(217): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttanacagctccgacagtaagaactacttatcttggttaccaacagaaaccaggacagcctacctaaaattactactatttatccacatctatgcggcctccggggtccccacgattcagtgcagcggtctgggacagtatttcactctcacatcagccaccctgcagactgaaagatggtggtcgttttatattgtaccaaataattatttcttctttgtttacccgtttaatttccgggacgggtagggaaccctaaaggggttggaagtaatacaaaacggtacgtggtaggccttaggaccaacctagttaccttcgttcctttacaatttcccttccccgactacttctaggtatttacc

SEQ ID NO: 431913 - DNA, 617 bp, Homo sapiens
  misc_feature: GZ8MTXP02F907V.11.31.C09.1.454.CMB.2.raw
  modified_base (376)..(376): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtattattttatacagctccgacagtaagaactacttatcttgtccaacagaaaccaggacagcctactaaattactactatttactccactatctatcggccgggcccgtccggggtcccccgaccgtattcaggtcggcaggcgggtctgggacagtactttcactcncacatcagccacgcctgcagactagaagtatggtggggttactttattagttcgtacaaactattatttcctcgttttagtttaccgtttaagtttcggggacggtaacgggaccgtaaggggtggaagtagtaaccgaaaacggtactaggtggaccttagccgtaaaccgtcttacccgttgtttcccttaaccgtaccctttcccgttaccccgtaccttacgttaccgtacgtaacg

SEQ ID NO: 431914 - DNA, 616 bp, Homo sapiens
  misc_feature: GZ8MTXP02JDWQB.11.31.C09.1.454.CMB.2.raw
  modified_base (216)..(216): a, c, t, g, unknown or other
  modified_base (391)..(391): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttanacagctccgacagtaagaactacttatcttggtccaacagaaaccaggacagcctacctaaattactactatttatccacatctatgcggcctccggggtccccgaccgattcagtcgctaggcggtctgggacagtatttcactctcacatcagccagcctgcagactgaaagntcggtggtacgtttattgttagtacaaactaattatttccttacgtttcgttttaccgtttaaagttttccgggggacggtaacggggtaacccgaagggggttggtaacgtaagttaccgaaaaacggtaccgttaggttcgggacttacggactaacccgtattccgttacgttcctttaacgaccgtttccttacccccggatacggtccttacggtttaac

SEQ ID NO: 431915 - DNA, 524 bp, Homo sapiens
  misc_feature: GZ8MTXP02JS6H9.11.31.C09.1.454.CMB.2.raw
tcagcgagagataccacgaccggtgctcgatttagacgtctcatcaaggaaggaagggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaaacagaaaccaggacagcctcctaaatactcatttatccacatctatgcggcctccggggtccccacgattcagtggcagcggtctgggacagatttcactctcacaatcagcagcctgcagactgaagatgtgggctttatattgtacaaacattaattctactttgtttaccgtttaatttcgggacgtagggaaccaagggtggagatacaaaacgaactggtacggctgccacctatctgtcttcactccttcccgcatcctgtaac

SEQ ID NO: 431916 - DNA, 573 bp, Homo sapiens
  misc_feature: GZ8MTXP02I3W6L.11.31.C09.1.454.CMB.2.raw
  modified_base (217)..(217): a, c, t, g, unknown or other
  modified_base (257)..(257): a, c, t, g, unknown or other
  modified_base (300)..(300): a, c, t, g, unknown or other
  modified_base (344)..(344): a, c, t, g, unknown or other
  modified_base (560)..(560): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtattatttanacagctccgacagtaagaactacttatcttggtaccaaanagaaaccaggacagcctacctaaattactactatttataccanatctatgccggcctccggggccccacgattcagtgcagcggtcngggacagtacttcactctacactaatcagcagcctgacaagctagaaagcgtggtggtactttatattgtacaaactaattattcttcgtttacggtttaccttaagtttccggggaggtaacgggtaacctaaggggtgaagtacgtaaccgaaaacgtaacgttggtcggactcggaccaacgtacttctgttacctaagacttccgttacccnctatcctaggtac

SEQ ID NO: 431917 - DNA, 578 bp, Homo sapiens
  misc_feature: GZ8MTXP02FRFOK.11.31.C09.1.454.CMB.2.raw
  modified_base (429)..(429): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggtccaaacagaaaaccaggacagcctacctaaaattactcaatttattccaactatctatgcgggccctccggggtccccaccgattcagtggcagcgggtctgggacagatttcactctcacaatcaagcagcctgcaagactgaaagatggtggggtacttttaatattgtaccaaaanaattatttcctgtttgtttaccgttttaaatttcgggcggaaaggggacccaaaaggggtgggaataactaaccgaaaaacgtactggtggcgtcgacaccactctcgttcttaactacttaccttacccgtacctactactacgtacg

SEQ ID NO: 431918 - DNA, 584 bp, Homo sapiens
  misc_feature: GZ8MTXP02IL8IT.11.31.C09.1.454.CMB.2.raw
  modified_base (219)..(219): a, c, t, g, unknown or other
  modified_base (370)..(370): a, c, t, g, unknown or other
  modified_base (397)..(397): a, c, t, g, unknown or other
  modified_base (497)..(497): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagacgggccaccatcaactgcaaggcaagccagatttattttanacagctccgacagtaagaacttacttatcttggttaccaacagaaaccaggacagcctctaaattactctatttatccatatctatgccgggcctccggggtccccgaccgattcagtggcgaggcgggtctgggacagtatttccactcncacatcagcacgctgacagactgaagngtggtgggtctttttaatagttgtaacaaactattactttccttctttcggttttaccgtttaagtttcggggacggtaacgggactaagggtgaaagtntacgaaaacgtagtggtagctcggaccaaaccgttcttaccgttcgttaccttctacctttcccgtaccccgtatacttcgtagtac

SEQ ID NO: 431919 - DNA, 582 bp, Homo sapiens
  misc_feature: GZ8MTXP02FIMNT.11.31.C09.1.454.CMB.2.raw
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggtccaaacagaaaccaggacagcctacctaaaattactcattttattccaactatctatgcggcctccggggtccccacgattcagtgcagcggtctggacagatttcactctcacaatcagcagcctgcagactagaagatggtgggtcgtttattattgtacaaactaattatttctctttgtttcccgtttaaattttcggggacggacgggtacctaaagggtggaagatacgaaaacgtaacgttggtggccttacggacctaacccagttcctgtttaccttaaccgactttcccgtttcccccggacctaattcccgtaggttaacg

SEQ ID NO: 431920 - DNA, 607 bp, Homo sapiens
  misc_feature: GZ8MTXP02FH6FN.11.31.C09.1.454.CMB.2.raw
  modified_base (235)..(235): a, c, t, g, unknown or other
  modified_base (257)..(257): a, c, t, g, unknown or other
  modified_base (294)..(294): a, c, t, g, unknown or other
  modified_base (595)..(595): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtattattttatacagctccgacagtaanaactacttatcttgtccaacanaaaccagacagcctactaaattactctatttatccanatctatcggccggccccgtcccggggtcccccgaccgtattccaggtcggcgaggcggggtcgtcggggaccagtatttccactcctacacaatcagcacgcctgcaagtactagaagtagttggtgggttactttatttagtcgtacaaaactaattacgtttcctcgttttcgtttaccgttttaagtttccggggacgggtaaccgggtaacgtagggtacggagtaactaacgtaaaacgtacgtggtacggacttcgactaactcgttcctgtttacctctacgttccctccccgntactctagtacc

SEQ ID NO: 431921 - DNA, 560 bp, Homo sapiens
  misc_feature: GZ8MTXP02GH5HD.11.31.C09.1.454.CMB.2.raw
  modified_base (218)..(218): a, c, t, g, unknown or other
  modified_base (229)..(229): a, c, t, g, unknown or other
  modified_base (288)..(288): a, c, t, g, unknown or other
  modified_base (299)..(299): a, c, t, g, unknown or other
  modified_base (408)..(408): a, c, t, g, unknown or other
  modified_base (434)..(434): a, c, t, g, unknown or other
  modified_base (470)..(470): a, c, t, g, unknown or other
  modified_base (530)..(530): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagatttattttanacagctccganagtaagaactacttatcttggtaccaacagaaaccaggacagcctacctaaaattactnaatttatccanatctatgcgggcctccggggtccccacgattcagtggcagcgggtctggggacagatttcactctcacaatcagccagtccctgcagtactagaaagatggtcggggtntttaatttattcgtacaaactaattntttctcgtttgtttacccgttttaaatttccggggngtaacggggaccaaaggggttggaagactacaaaacggtaactggtggcttgccaaaccntctgtctctactcctcctcctactctgtag

SEQ ID NO: 431922 - DNA, 638 bp, Homo sapiens
  misc_feature: GZ8MTXP02GF2NX.11.31.C09.1.454.CMB.2.raw
  modified_base (441)..(441): a, c, t, g, unknown or other
  modified_base (624)..(624): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtattattttatacagctccgaacagtaagaacttacttatcttggttaccaacagaaaccaggacagtcctacctaaattacctatatttactaccatatctagcggccgggtcccgtccccggggtaccccaccgtattccgaggtggcagggccggtcgtgggactagtactttcacctcctacactaacgtcaagcaacgctgacagactagaagtagtggtacggggttntttattattacgtacaaactatttaactttccttacttttacggtttacccgttttaagtttccgggggacggtaacgggtaaaccgtagggggttacggaaagtaactacgtaaaaacgtcggttagttacgggacttcggaccaactacgttcttacgtccttaacacgttccctccccgntacttcctagttac

SEQ ID NO: 431923 - DNA, 610 bp, Homo sapiens
  misc_feature: GZ8MTXP02HLGEE.11.31.C09.1.454.CMB.2.raw
  modified_base (218)..(218): a, c, t, g, unknown or other
  modified_base (455)..(455): a, c, t, g, unknown or other
  modified_base (564)..(564): a, c, t, g, unknown or other
  modified_base (591)..(591): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagaccttcctatttgtatctcgtgggcgagagggccaccatcaactgcaaggcaagccagattatttanacagctccgacagtaacgaactacttatcttggtaccaacagaaaccaggacagcctacctaaattactctaatttactccactatctagtcgccgggtccctcccggggtcccccgaccgtacttccgagtcggcgacggccggggtcgtcggggactaggtatttcactcctacactaatcagccagcctgcagtactagaatagtggttaggtactttatatgtacaataattntctttgttacgtttcgtttaaagttcggggacgtacggggacctaaggggtgaacgtagtaaccgaaaacgtacgttggaggactcggaccaaaccttcgtaccgtttntccctttaagactttcccggtaccccncctatcccgtttaggaccg

SEQ ID NO: 431924 - DNA, 626 bp, Homo sapiens
  misc_feature: GZ8MTXP02HPQPD.11.31.C09.1.454.CMB.2.raw
  modified_base (239)..(239): a, c, t, g, unknown or other
  modified_base (260)..(260): a, c, t, g, unknown or other
  modified_base (297)..(297): a, c, t, g, unknown or other
  modified_base (381)..(381): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccgaacggggacatcgtgatgacccagtctccagacttcctatttgtatctcgtgggcgagacgggccaccatcaactgacaaggcaagccagtatttatttatacagctccgacagtaanaactacttatcttgtaccaanagaacagacacacctactaaatactctattactccanatctagtgccggccgtcccggggtccccacgtattcgagtggcgaggcggtcgtcgggacagtactttcactctcactaatcancacgcctagcaagctaggaaagtcggttgggttggttacttttagtttagttcgtaaacctaaaacttattacttttccgtttcgttttaccggttttaaccgtttttaagggtttcccggggacgggtaacggtaaccgtaagggtgaacgtaaatacccgtaaaagtacgtgggtactcgtacgacctaactacgttctcttaccgttctaccttcccgtcccccgattactcttagtaaccg

SEQ ID NO: 431925 - DNA, 650 bp, Homo sapiens
  misc_feature: GZ8MTXP02G7NHI.11.31.C09.1.454.CMB.2.raw
  modified_base (301)..(301): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtatttattttatacagctccgacagtaagaactacttatcttggttaccaacagaaaccaggacacgcctactaaattactactatttatccanatctatgccggcccgtcccggggtccccgaccgtattcgaggtcggcaggcgggtcgtcggggacagtatttcacttcacacaatcagcacgcctgacagactaggaagacgttggtgggtacgtttttatagttcgactaaaactatttacttccgttttctttacgggttttacccgttttaaacggtttccggggaacggggtaacggtaaaccgtaagggggttcgaagtaccgttaaacaaaacggtcgtaggtacgggtactcgaaccgaacctacgtcgtttcgtacctttaacctacgtttccccgttcccccgactttacgttaccgttaggtttaaacc

SEQ ID NO: 431926 - DNA, 777 bp, Homo sapiens
  misc_feature: GZ8MTXP02HKEHU.11.31.C09.1.454.CMB.2.raw
  modified_base (217)..(217): a, c, t, g, unknown or other
  modified_base (229)..(229): a, c, t, g, unknown or other
  modified_base (341)..(341): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagacgggccaccatcaactgcaaggcaagcagatttatttanacagctaccganagtaagaactacttatcttggttaccaacagaaaccaggacacgacctactaatactctatttactccactatctagtcggaccggcccgtccccggggtaccccgaccgtntttaccgaggttcgggacgacgggccggggttacgtggggaaaccgtagtactttaccacttcctacgacctaactccgagacccgaacgtccccgtagcccgaaagtacctaaggtaaacgtacggtttgggttacgggggtttaaccgtttttaattacgtttaacggtaacctaaaaaccttaaagttttaccttttactttttaccgtttacgggtttttttaacccccggtttttaagggtttacccgggggttaacccggggtaaacgggtaaacccggttaagggggttacgggaaacgttaagttaaaccggtaaaaccggtaaactttggggacgtaccggtacgtaaacccctccgtactttccgttaggttacccttaacgtaccttcccgtttaccccccgtagttaccgttccgttacgtacg

SEQ ID NO: 431927 - DNA, 573 bp, Homo sapiens
  misc_feature: GZ8MTXP02HTLLW.11.31.C09.1.454.CMB.2.raw
  modified_base (217)..(217): a, c, t, g, unknown or other
  modified_base (255)..(255): a, c, t, g, unknown or other
  modified_base (263)..(263): a, c, t, g, unknown or other
  modified_base (269)..(269): a, c, t, g, unknown or other
  modified_base (293)..(293): a, c, t, g, unknown or other
  modified_base (369)..(369): a, c, t, g, unknown or other
  modified_base (509)..(509): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagtattatttanacagctccgacagtaagaacttacttatcttgtcaaanagaaaccnggacancctactaaatctcatttactccanatctatgccgggccctccggggtccccacgtattcgagtggcaggcgggtctcgggacagtatttccacttcctanactaatcagcaacgcctgcagactgaagatggtgggtactttattacgttgtacaaacaattactttacctctttacggtttaccgttttattcgggacggtagaccgagggttaggatagtaacaaaacgtagttacgnggtactcgactaaccagttctagttccttaactcttaccttccccgactagttcttaggtaacg

SEQ ID NO: 431928 - DNA, 633 bp, Homo sapiens
  misc_feature: GZ8MTXP02JBXHI.11.31.C09.1.454.CMB.2.raw
  modified_base (306)..(306): a, c, t, g, unknown or other
tcagcgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgacaaggcaagccagtatttaattttatacagctaccgacagtaaagaactacttatcttggttaccaacaacgaaaccaggacagacctactaaatactctatttactccanatctatcggccggtcccgtccccggggtccccgaccgtacttcgagtggcgtaggccgggtcgtcgggacagtacttcactctcacaatcagcacgcctgacagactagaagtagttgggtagggttacttttaatttagttcgtaaacctaaacttaatttactttccttagtttacggttttacccgtttaaagttccggggaggtaaacgggacctaaagggtggaacgtaactaacgaaaacgtaacgttcgggtacgccttaggacccacgtacgttcgtcgttcttaaccactttcccgtaccctctagtttctacggtac

SEQ ID NO: 431929 - DNA, 547 bp, Homo sapiens
  misc_feature: GZ8MTXP01D41L5.44.43.D10.1.454.CMB.2.raw
  modified_base (398)..(398): a, c, t, g, unknown or other
  modified_base (441)..(441): a, c, t, g, unknown or other
  modified_base (541)..(541): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaaggtggttcgaccccctggggcccaggggaacccctgggtcaccgtctcccncagctccaccaacgaccactcgtccttccctcgcggcctcgcnccgacgcgcacctcgtcgggtcgacgacgccggcccgtcggcgtcgccgtcggtcgaacggacgttaccttaaccttaacttaacttactcgttcgtcgnggcggg

SEQ ID NO: 431930 - DNA, 575 bp, Homo sapiens
  misc_feature: GZ8MTXP01DUTT1.44.43.D10.1.454.CMB.2.raw
  modified_base (344)..(344): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcacatgaccagacacctcataacacagcctacatggagctgagcagcctgagatctgaggacacggccgtgtattactgtgcgagatacccgaaagtatagcagctcggtcggggnggtggttccgaccccgtgggggacccaggggaacccctgggtccaccgttctccgtcagtccttacccgaccaaacgggccccaagtccggtccttcccccgtggccggccccttcggcctcccgaggacgccacccgtcggtcgggggccacgacggccggccccgtgggccttcggccgtggtccaagggttcttaccttcctataacttactgttctgaacggccggg

SEQ ID NO: 431931 - DNA, 586 bp, Homo sapiens
  misc_feature: GZ8MTXP01DMQA9.44.43.D10.1.454.CMB.2.raw
  modified_base (312)..(312): a, c, t, g, unknown or other
  modified_base (348)..(348): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtatttacngtgcgagatcccgaaagtatagcagctcgtcggggngtggttcgaccccgtggggccagggaaccctgtcaccgtctcctcacgcttccaccgaacgggccccagtcccgtccttccccctcgggcccggccccgttcggccttcccgacggacgccgtacccgtccgtcgggggccacgacggccgggccccgttcggggccgtcggcccgtcgggttccaacgggaccttaccgttccctaattaactacctgttccttggaacgtccgggg

SEQ ID NO: 431932 - DNA, 547 bp, Homo sapiens
  misc_feature: GZ8MTXP01BRWG5.44.43.D10.1.454.CMB.2.raw
  modified_base (268)..(268): a, c, t, g, unknown or other
  modified_base (333)..(333): a, c, t, g, unknown or other
  modified_base (353)..(353): a, c, t, g, unknown or other
  modified_base (393)..(393): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcacatgaccagaacacctacataaacacagcctacatgganctgagcagcctgacgatctaggaggacacggccgtagtatttactgtgcgagactaccgaaagtntagcagctacgggtcggggnggtcggtccgacccgtggggccagggaccctgccacgtcnctcagctccacgacggccagtccggtcctccccgtcggccgtccctcgcctaccgaggaccgcctaccgtcggtcggggccacgcgccggcccgtgggcctcgccgtggtacaacggccttaccttcctataactactgttcctggcggccggg

SEQ ID NO: 431933 - DNA, 613 bp, Homo sapiens
  misc_feature: GZ8MTXP01EYC4C.44.43.D10.1.454.CMB.2.raw
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgagacacggccgtgtattactgtgcgagactacccgaaagtatagcagcctcgggtcgggggaaggttcgggttccggaacccccggttgggggacccgtaacgggggaaaccccttcgggtaccgtacccggttcctccctcgaacggccctttacccgaaccgaaacggggccccacgtccgggtcccttcccccgtcggcccggtcccgtcggcctccgaggacgccgacccgtcgtcggggccacgacggccggcccgtcgggcctcgccgtcggtcaacggcttaccttcctatcgtactcgttacgtcgaacgccggg

SEQ ID NO: 431934 - DNA, 583 bp, Homo sapiens
  misc_feature: GZ8MTXP01A5KIU.44.43.D10.1.454.CMB.2.raw
  modified_base (273)..(273): a, c, t, g, unknown or other
  modified_base (288)..(288): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctaccaataaacacagcctacatgganctgagcagcctgagntctgaggacacggcgtgtattactgtgcgagactacccgaaagtatagcagcgtacgggtcgggggaaggtcggttcccggacccggtcgggggccaacggggaaccccttcgggtaccaccggttcctccctcgacgtcccttacccgaccgaacgggcccctacgttccgtcccttccccgtcggccggtcccctcgcctccgagccgccgaccgtcggtcggggcacgcgccggccgtcgggctgccgtggtacacggttcttacgtcctatcttactgttactggcgcggg

SEQ ID NO: 431935 - DNA, 576 bp, Homo sapiens
  misc_feature: GZ8MTXP01BWJGN.44.43.D10.1.454.CMB.2.raw
  modified_base (268)..(268): a, c, t, g, unknown or other
  modified_base (329)..(329): a, c, t, g, unknown or other
  modified_base (349)..(349): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggacacctcataacacagcctacatgganctgagcagcctgagatctgaggacacggccgtagtattactgtgcgagactcccgaaagtntagcagcgtcggtccggggnggtcgttccgaccccgtggggcccaggggaacccctggtaccgacccgtctccctcacgtccttaccccgaccgaacgggccccagttccgggtcccttcccccgtcggcccgccccgtcgcctccgacggacgccgaccgtcggtcggggccacgcgccggcccgtcgggctcggccgtcggtcacggttcttaccttcctataactctgttctcggaaggccggg

SEQ ID NO: 431936 - DNA, 575 bp, Homo sapiens
  misc_feature: GZ8MTXP01B0VF6.44.43.D10.1.454.CMB.2.raw
  modified_base (268)..(268): a, c, t, g, unknown or other
  modified_base (349)..(349): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcacatgaccagaacacctcataaacacagcctacatgganctgagcagcctgagatctgaggacacggccgtgtattactgtgcgagactcccgaaagtatagcagcgtcgggtcgggggnggtcggttccgaccccgtggggccacgggaccctggtcaccgtctcctcagccttccaccgaacggcccagtccgtccttcccccgtcggccggtccccgtcgcctcccgaggtcgccaccgtcgtcgggggccacgacggccggcccgtggggcctcggcccgtcgggtccgaacgggttccttaccgttccctataacttacgtgttcgtcgaacggtccgggg

SEQ ID NO: 431937 - DNA, 617 bp, Homo sapiens
  misc_feature: GZ8MTXP01B7S7M.44.43.D10.1.454.CMB.2.raw
  modified_base (346)..(346): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggnggtggttcgaccccgtgggggccaggggacccctgggtccaccgtctcccgtcacggccttacccgaccaacggggccccctaagtcccgggttccctttcccccccgtcggggcccggtcccccgttcgggcccttccccgacgggacgtcccgaacccgttccgtcggggggtcccacgacggcccgggccccgtggggccgttcgcccgttggggtccaacgggttccttacgttccctataacgtactgttcctggaacgtccgggg

SEQ ID NO: 431938 - DNA, 629 bp, Homo sapiens
  misc_feature: GZ8MTXP01BUK0W.44.43.D10.1.454.CMB.2.raw
  modified_base (269)..(269): a, c, t, g, unknown or other
  modified_base (349)..(349): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggacacctcataaacacagcctacatgganctgagcagcctgagatctgagacacggccgtgtattactgtgcgagactacccgaaagtatagcagctacggtcgggggnggtcgggtttccgacccccgtgggggccccaacggggaaacccctgggtcccgaacccgttcctcccgtcgacgtcctttacccgaacccgaaacggggcccctaagtcccggttcccttccccccgttcgggcccggccccgttgccctcccgacggaccgccgacccgtccgtcgggggccaccgacgccgggcccgtggggcccttcggccgtcggtccaacgggttccttaccgtttccctattaactacgttcgttcgttcggaacggtccgggg

SEQ ID NO: 431939 - DNA, 559 bp, Homo sapiens
  misc_feature: GZ8MTXP01DQ942.44.43.D10.1.454.CMB.2.raw
  modified_base (385)..(385): a, c, t, g, unknown or other
tcagacagtatatacacgaccggtgctcgatttagactagcagtaaggggctgaggtagaagaagcctggggcctcagtgaaggtctcctacaaggcttctggatacaccttcaccaattatgatatcaactgggtgcgacaggccactggacaagggcttgagtggatgggatggatgaaccctaacagtggtaacacaggctagtgcacagaagttccagggcagagtcacatgaccagacactccataacacagctacatggagctgagcagcctgagatctgaggacacggccgtgtattactgtgcgagataccgaagtatagcagctcggtacgggagtggtcacccgtgggccacgggacctggccaccgtctcctcncgcttccaccgagggcccagtccgtcctcccctgccgcccgtcgcctccacgggacgccgaccgtcgtcgggggccacgtacggtcggcccgtcgggtcttcggtcccgttgggttccgaacgggttacgttaccgttactaactaatcgtcgtccgttggtaacgcgggtccg

SEQ ID NO: 431940 - DNA, 605 bp, Homo sapiens
  misc_feature: GZ8MTXP01BXEGL.44.43.D10.1.454.CMB.2.raw
  modified_base (187)..(187): a, c, t, g, unknown or other
  modified_base (284)..(284): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatgaccagaacacctcataaacacagcctacatggagctgagcagcctgagntctggagaccacggtccgtagtattacgtgtgacgaagactacccgaaaagtatagcgagcgtacgggtcgggggtcggtcgggttcccggaccccggtcgggggacccgaacggggtaaccccgtggtacccgacccgtcctccgtcgacgtccttacccgaccgaacgggccctacgtcccgttccctccccgtcggcccgtcccgtcgccgtccgacggacgccgtaccgtcggtcgggccacgcggcccggccgtgggcctcgccgtcggtacaacggttccttactcgtatcgttcgtcgttcgtcggcgtccggg

SEQ ID NO: 431941 - DNA, 610 bp, Homo sapiens
  misc_feature: GZ8MTXP01DD3P5.44.43.D10.1.454.CMB.2.raw
  modified_base (283)..(283): a, c, t, g, unknown or other
  modified_base (286)..(286): a, c, t, g, unknown or other
  modified_base (327)..(327): a, c, t, g, unknown or other
  modified_base (345)..(345): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgacagaacacctcataaacacagcctacatggagctgagcagcctgagntcngagacacggccgtgtattactgtgcgagactcccgaaagtnagcagcgtcggtcggggnggtcggttccgaccccgtggggacccacggggtaaccctcggtcctaccgtccgtcctcacggtccttaccaccgaacgggccccacgtccggtcccttcccccgtcgggcccggtccccgtcgtccgtcccgacggaccgcctaccgtccggtcgggggtcccacggacggcccgggcccgtcgggcctcggccgtacgggtccaacgggttccttaccgttccccttaagttcttaccgtggttacttaacggcggtccgggg

SEQ ID NO: 431942 - DNA, 775 bp, Homo sapiens
  misc_feature: GZ8MTXP01D49JL.44.43.D10.1.454.CMB.2.raw
  modified_base (187)..(187): a, c, t, g, unknown or other
  modified_base (270)..(270): a, c, t, g, unknown or other
  modified_base (284)..(284): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatgaccaggaacacctcataaacacagcctacatgganctgagcagcctganatctggagacacggccgtgtattactgtgcgagactacccgaaagtatagcaggtccgtacgggtacgggggtaaggttcgggtttacccgggaacccccggttgggggaccccgtaacgggggtaaacccccttgggtacccgtacccggttcctccccgttaccgaccgtcccgtttaccccgaacccggtaaccgggaccccgtaaccgttccccgggttccccgtttccccccggttccgggtccccgggtcccccgttcggtccccgttacccggaaccgggaacccgcccgtaaccccggttccgggttacgggggtccccgtaaccggtaccgggcccgggtcccccggttgggggttcccccccgttgggttccccggttacggggtaacccgttaaaccggggttacccttaacccgtttaaccccttaaggtttaaccttaaccgttcggttcccgttaagggttaaccgggtcccggggg

SEQ ID NO: 431943 - DNA, 577 bp, Homo sapiens
  misc_feature: GZ8MTXP01BAVEG.44.43.D10.1.454.CMB.2.raw
  modified_base (353)..(353): a, c, t, g, unknown or other
  modified_base (475)..(475): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctggaggacacggtccgtgtattacgtgtgcgagactaccgaaagtatagcagctcgggtcggggngtcggtccgacccgtggggaccacggggaccctggtcaccgtctcctcacgtccttccaaccgaacgggccccagtcccggtccttcccccgtcgggcccgtcccgtcgcctcccgaggacnccgaccgtcggtcggggccaccgcggccggccccggtgggccgtcggccgtcgggtcaacggccttaccgtcctataactccgtgttccgtggcggtccggg

SEQ ID NO: 431944 - DNA, 530 bp, Homo sapiens
  misc_feature: GZ8MTXP01DNAQ7.44.43.D10.1.454.CMB.2.raw
  modified_base (329)..(329): a, c, t, g, unknown or other
  modified_base (347)..(347): a, c, t, g, unknown or other
  modified_base (525)..(525): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtntagcagctcggtcggggnggtggttccgaccccgtgggggccccaggggaaccctggtccacgtctcctcagccttccaccaacggcccactcgtctcccctcggcgccctcgcctccgagacgcaccgtcgtcgggggcacgcgcggcccgtgggctcgcgtggtcaacggcttacttcctatctactgttctgngcggg

SEQ ID NO: 431945 - DNA, 549 bp, Homo sapiens
  misc_feature: GZ8MTXP01DWP35.44.43.D10.1.454.CMB.2.raw
  modified_base (349)..(349): a, c, t, g, unknown or other
  modified_base (542)..(542): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacacagcctacatggagctagagcagcctgagatctgaggacacggccgtgtattactgtgcgagataccgaaagtatagcagcgtcggtcggggnggtcggtccgacccgtggggccacgggacctggtccacgtctcctcacgccttaccaccgacgggcccacgtccggtcccttcccccgtcggccggtcccctcgcctccgacggcgccaccgtcgtcgggggcacgcgccggcccgtcgggctcgccgtggtcaacggttcttactcctatctactgttctgngtccggg

SEQ ID NO: 431946 - DNA, 873 bp, Homo sapiens
  misc_feature: GZ8MTXP01CI7DC.44.43.D10.1.454.CMB.2.raw
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacacagcctacatggagctgagcagcctgagatcgtaggacggaccacgggtcccgttaggttaactttaaccgtggttacggacgtaaacggtaacgttaacccccggtaaaaacggttacgttaacggaccgtaacggtcccggtttaaccgggggttaccgggggggtaacggggttcgggggttttacccccgggaaacccccccgggtttcggggggggacccccgtaaaccggggggtaaaccccccgtttcggggtaccccgtaaccccgggttcccttccccgttaccgaaccggttaccccgtttacccccgaaaccccggtaaaccgggggtcccccctaacggttccccggggtttccccctttcccccccggtccggggtcccccggtcccccgttcggtacccccgttacccggaacggggtacccgaccccggtaacccggttcccggggtccggggggaaccctaccccgggtacgggccccgggtcccccggttggggccccgttccggttcccggtacgggttaccgaaacgggttcccttaaccggtttccctaagtttaacttaccgttcggttaccgttaacgggaacgggttcccgggg

SEQ ID NO: 431947 - DNA, 607 bp, Homo sapiens
  misc_feature: GZ8MTXP01CF6UY.44.43.D10.1.454.CMB.2.raw
  modified_base (271)..(271): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatgganctgagcagcctgagatctggacggacacggccgtgtatttactgtgcgagatacccgaaagtatagcagcgtcgggtcgggggtggtcgggttccggaccccgtgggggcccacggggaaccctggtccacccgtctcctcgacgtccttaccgaccgaacgggccccacgttccggtccttcccccgtcggtcccggtccccgtcggtcctacccgaggaccgccgacccgtcggtcgggggccacgacggccggccccgtcggggcctcggcccgtcggtccgaacgggccttaccgttccctattaactacgtcgttcgtcgaacggtccggg

SEQ ID NO: 431948 - DNA, 529 bp, Homo sapiens
  misc_feature: GZ8MTXP01CZ6E7.44.43.D10.1.454.CMB.2.raw
  modified_base (186)..(186): a, c, t, g, unknown or other
  modified_base (344)..(344): a, c, t, g, unknown or other
  modified_base (393)..(393): a, c, t, g, unknown or other
  modified_base (439)..(439): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcacatgaccaggaacacctcataaacacagcctacatggagctgagcagcctgagatctgaggacacggccgtgtattactgtgcgagatcccgaaagtatagcagctcgtcggggngtcgggttcgaccccgtggggcccaggggaaccctggcaccgtctcctncgctccacaacggcccatcgtctccccgtgcgccctgcctccgagngccacgtcgcggggcacgagccggcctgggctgccgtcggtcaagggttccttacttccctaattcgtaacctgttcctggcgtccgggg

SEQ ID NO: 431949 - DNA, 577 bp, Homo sapiens
  misc_feature: GZ8MTXP01AZ4GR.44.43.D10.1.454.CMB.2.raw
  modified_base (270)..(270): a, c, t, g, unknown or other
  modified_base (350)..(350): a, c, t, g, unknown or other
  modified_base (569)..(569): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacacagcctacatgganctgagcagcctgagatctggacgacacggccgtgtattacgtgtgcgagactccgaaatatagcagcgtcgggtcggggnggtcgggtccgaccccgtgggggcccaacggggaccctcggtcctaccgtcctcctcgacgtccttacccgaccgaacgggccccacgttccgtcccttccccgtcggcccggtcccgtcgccctccgacgacgccaccgtcgcggggtcaccgcgccggccgtcgggccgtcgccgtcggtcgacggttcttaccgttcctataactctgttccgtgnggtccggg

SEQ ID NO: 431950 - DNA, 584 bp, Homo sapiens
  misc_feature: GZ8MTXP01EHSE9.44.43.D10.1.454.CMB.2.raw
  modified_base (328)..(328): a, c, t, g, unknown or other
  modified_base (347)..(347): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcacatgaccaggaacacctcataaacacagcctacatggagctgagcagcctgagatctgaggacacggccgtgtacttactgtgcgagactccgaaagtntagcagctacggtcggggnggtcgttccgaccccgtggggcccacggggaccctggtccaccgtctcctcacgccttacccgaccgaacgggcccacgttccggtccttccccgtcggtccggcccgtcgcctccgaggcgcctaccgtcgtcggggccacgcggccggcccgtgggccgtcggccgtcgggtccgaaacgggttccttaccgttccctaagtaacttacgtcgttcgttcgaacgggtcccgggg

SEQ ID NO: 431951 - DNA, 690 bp, Homo sapiens
  misc_feature: GZ8MTXP01BEX0H.44.43.D10.1.454.CMB.2.raw
  modified_base (186)..(186): a, c, t, g, unknown or other
  modified_base (273)..(273): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatcgaccagaaccacctaccaataaacacagcctacatgganctagagcagcctgagatcgtggacggacacggtccgttgtactttacgtgtgcgaagactacccgaaaagtgtagcacgtccgttaacgggtcgggggtaacggttcgggtttacccgggaacccccgggttcgggggaccccgtaaccgggggtaaacccccgttcggggtacccgtaaccccggttccgttaccccgtaccgtaccgtacccgtttaccccgaaacccggtaaaccggggtcccctaacgttccccggttccccttcccccgtcggcccggtcccctcggcccttacccgacggtaccgcccgtacccgtccgggtcggggtccaccgcggccgggtcccgtcgggcctcggccgtggtaccacggttccttacgttcctatctcgtgttccgtggcggtccggg

SEQ ID NO: 431952 - DNA, 584 bp, Homo sapiens
  misc_feature: GZ8MTXP01DMD1Y.44.43.D10.1.454.CMB.2.raw
  modified_base (506)..(506): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgtacagaagttccagggcagagtcacatgaccagacacctcataaacacagcctacatggagctgagcagcctgagatctgaggacgacggccgtgtattacgtgtgcgagactacccgaaaagtataggacagtcgtcggtacgggggagtcgggttccgacccgtggggacccacggggaaccctggtcccacccgtctcccttcacgtccttacccgaccgaaccgggtccctacgtccggttcccttcccccgtcggcccgcccgtcgcctccgaggacgccaccgtcgcgggggcncgacgccggcccgtcgggcttcggccgttcggtacgtaagaccttcgttacctaatatcgtgtcttggcgcgggtcgg

SEQ ID NO: 431953 - DNA, 571 bp, Homo sapiens
  misc_feature: GZ8MTXP01CW0E3.44.43.D10.1.454.CMB.2.raw
  modified_base (347)..(347): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacacagcctacatggagctgagcagcctgagatctgaggacacggccgtgtattactgtgcgagatacccgaaagtatagcagctcggtcgggnggtcggtcgaccccgtggggccacgggacccgtcggtccaccgtctcctccgacgtccttaccaccgaacgggccccacgtccggtccttccccgtcggccgggtcccctgccgtccgacggacgcgaccgtcgtcggggccacgcgccggcccgtcgggctcggccgtcgggtccaacgggttccttaccgttcctattctactcgttacgtgaaggtccggg

SEQ ID NO: 431954 - DNA, 605 bp, Homo sapiens
  misc_feature: GZ8MTXP01CO2MA.44.43.D10.1.454.CMB.2.raw
  modified_base (269)..(269): a, c, t, g, unknown or other
  modified_base (311)..(311): a, c, t, g, unknown or other
  modified_base (332)..(332): a, c, t, g, unknown or other
  modified_base (353)..(353): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcacatgaccaggaacacctcataaacacagcctacatgganctgagcagtcctgagatctgaggacacggccgtgtatttacngtgcgagactaccgaaaagtntagcagcgtcgggtacggggnggtcgggttacccgaccccgtgggggcccaacggggtaacccctgggtccaccgtcctcctcacgtcccttaccaccgaacgggccctacgtccggtccttcccccgtggccggtccccttgccctaccgacggaccgccgaccgtcgcggggccacgcggcccggcccgtggggccttcggccgttacgggcgttaacggttccttaccttaaccctattaactaccgtgttacgtcggaacggtccgggg

SEQ ID NO: 431955 - DNA, 808 bp, Homo sapiens
  misc_feature: GZ8MTXP01CQ99T.44.43.D10.1.454.CMB.2.raw
  modified_base (187)..(187): a, c, t, g, unknown or other
  modified_base (275)..(275): a, c, t, g, unknown or other
  modified_base (327)..(327): a, c, t, g, unknown or other
  modified_base (386)..(386): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatgaccaggaaccacctaccaataaacacagacctacatgganctgagcagcctgagatcgtagacggaccgacggtccgttgttaactttacgnggtgacgtaagtacgtaccgaaagtactacgcgacggtccgtacggggttaccgggggngggttcgggttaccccggacccgggtgggggacccgtaacgggggtaaacccctgggtccctaacccggtccttcccgtacgtaccggtccccttaaccgaaccccggtaaacgggcccccgtaacggttccccgggttcccctttccccccgggtcgggtcccccggtcccccgtttacggtccccgtacccggtaacggggaccccgtcccgtaaccccggtttaccgggggtccggggggacccaaacccgggtccgggggccccggggtccccggttcggggcccgttcccgggttacccggttacggggttaaccccgttaaaacgggttaccccttttaacccggtttccccgtaaaattttaaccgaaccccggtttttggaacccgtttcggggttaaccggggtccccggggg

SEQ ID NO: 431956 - DNA, 706 bp, Homo sapiens
  misc_feature: GZ8MTXP01AQOHD.44.43.D10.1.454.CMB.2.raw
  modified_base (187)..(187): a, c, t, g, unknown or other
  modified_base (288)..(288): a, c, t, g, unknown or other
tcagacagtatatacacgaccggtgctcgatttagactagcagtaagggactgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatgaccagaacacctcaataaacacagcctacatggagctgagcagcctgagatcngaggacacggccgtgtatttacgtgtgacgagacgtaccgaaagtatagcgaagccgtcggggtacgggggtgggttcgggtttacccggaaccccccgggttgggggaccccgaacgggggtaaaccccgtcgggtacccgtacccggtccttccctcgtaaccggtcccttaccccgaaccgaaaccggggtcccctaccggttcccgggttccccttccccccggttcgggaccccgggtccccttcggcccgttacccgacggaccgtacccgacccggtttcggcgggggtccaaacggccgggcccgggccccggtgggttcccgtcggttccccggtagggtacgaaacgggttcctttaccttccttaacgttaacttacggttggttccctaagggttcggtcccgggg

SEQ ID NO: 431957 - DNA, 614 bp, Homo sapiens
  misc_feature: GZ8MTXP01ELGK2.44.43.D10.1.454.CMB.2.raw
  modified_base (253)..(253): a, c, t, g, unknown or other
  modified_base (266)..(266): a, c, t, g, unknown or other
  modified_base (365)..(365): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcacatgacagacacctacataaacanagcctacatgganctgagcagcctgagatcgtgagacaacggccgtagtactttactggtagcgaagtactacccgaaaagttacgtagcacgtccgtacgggttacggggngggttcgggttacccgaccccggtggggacccctacggggaacccctgggtacctaccgtcctcccgtcgacgtcccgttacccaaccgtaacggcccacgttcccggtcccttccccgtcggccggtccccgtcgtccgtccgacggacgccgtaccgtcgcggggccaccgacgccgcccgtggcgtcgaccgtggtacgaacggttcttacttaacctatctaccgtgttccgtgttaacggtcgg

SEQ ID NO: 431958 - DNA, 752 bp, Homo sapiens
  misc_feature: GZ8MTXP01EX01Q.44.43.D10.1.454.CMB.2.raw
  modified_base (187)..(187): a, c, t, g, unknown or other
  modified_base (255)..(255): a, c, t, g, unknown or other
  modified_base (260)..(260): a, c, t, g, unknown or other
  modified_base (268)..(268): a, c, t, g, unknown or other
  modified_base (274)..(274): a, c, t, g, unknown or other
  modified_base (294)..(294): a, c, t, g, unknown or other
tcagacagtatatacacgaccggtgctcgatttagactagcagtaaggggctgaggtgaagaagcctgggacctcagtgaaggtctcctgcaaggcttctggatacaccttcaccaattatgatatcaactgggtgcgacaggccactggacaagggcttgagtggatgggatggatgaaccctaanagtaggtaacacaggctatgcacagaagttccgagggcagagtcaccatcgaccagaacacctacaanaaacncagcctanatgganctgagcagcctagagatcgnggacgacacggtccgtagtactttacgtggtcgacgagtacgtaccgaaagtctagcgaggtccgtacgggtacgggggtaacggttcgggtacccgggaccccgggtggggaccccgtaacgggggtacccccgttcgggttaccctaaccgggttcccttcccgttacgaccgtcccttacccgaaccgttaaccggggcccctacgttccccgggtcccctttcccccggtcggtccccggtaccccgtcggtacccgttaccggaaccggtccgtcccggtaaccccgtcggggttcccgggggaaccctaccggcccgggcccgggtccccggtcggggttccggttccgggttcccggtacgggtaacccgttaacgggttccctttaaccggtttccctaagtttaaccgttaccgttcgggttaccgttaacgggccgggggtcccgggg

SEQ ID NO: 431959 - DNA, 691 bp, Homo sapiens
  misc_feature: GZ8MTXP01B3815.44.43.D10.1.454.CMB.2.raw
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacgaggctatgcacagaagttccgagggcagagtcaccatcgaccaggaaccacctacataaacacagacctacatggagctgagcagcctgagatctggacgacacggtccgtagtactttactggtgtccgaagactacccgaaagtatacgcgacgccgtacgggtacggggtaacggttcgggttcccggaccccggtcgggggacccgtaaccggggtaacccgtcgggtacctacccgtacctccgtcgaccgtccttacccgaaccgtaaccgggcccctaacgttcccgttcccttcccccgttcggcccgggtccccgttcggcccgttcccgaacggtaccggacccgtaccgtacccgggtcgggggtacccaaccgccggcccgggtcccgtcggggcctcccggccggttacggtcgaaacgggttcccttaccgttcgtaacttaactaccgttggttccgtcgggttaacgggtccgggg

SEQ ID NO: 431960 - DNA, 523 bp, Homo sapiens
  misc_feature: GZ8MTXP02JSTTF.44.43.D10.1.454.CMB.2.raw
  modified_base (346)..(346): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatccgaaagtatagcagctcgtcggggngtggttcgaccccgtgggggccaggggaaccctggtcaccgtctcctcagctccaccaaggcccatcgtctcccctggccgccctgctccagacgcaccgtcgtcgggggcaccgagccggccctggggctcgcccgtggtccaacggacctactcctatactactgtctgagcggg

SEQ ID NO: 431961 - DNA, 536 bp, Homo sapiens
  misc_feature: GZ8MTXP02GBS8K.44.43.D10.1.454.CMB.2.raw
  modified_base (311)..(311): a, c, t, g, unknown or other
  modified_base (347)..(347): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattacngtgcgagatcccgaaagtatagcagctcgtcggggnggtggttcgacccctggggccaggggaccctggtcaccgtctcctcacgctccaccaacgggcccatccggtccttcccccgtcggccgcccctgcctaccgacggacgcacctcgtcgggggcaccgacgcggcccgtgggcctcgcccgtggtcaacggctacttcctatactactgtctgacgcgg

SEQ ID NO: 431962 - DNA, 555 bp, Homo sapiens
  misc_feature: GZ8MTXP02HLZ0C.44.43.D10.1.454.CMB.2.raw
  modified_base (350)..(350): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccaataaacacagcctacatggagctgagcagcctgagatctgaggacacggccgtgtattactgtgcgagatacccgaaagtatagcagctcggtcggggngtggttcgaccccgtggggccagggaccctggtcaccgtctcctcagcttccaccgaacggcccactccgtccttcccccgtcggccgccccttcgcctcccgaggacgccaccgtcgtcgggggcacgacgccggcccgtcggggcctcggcccgtcggtcgaacggtacctacttccgtatactactcgtctgtacggccggg

SEQ ID NO: 431963 - DNA, 543 bp, Homo sapiens
  misc_feature: GZ8MTXP02F2NMC.44.43.D10.1.454.CMB.2.raw
  modified_base (257)..(257): a, c, t, g, unknown or other
  modified_base (348)..(348): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacncagcctacatggagctgagcagcctgagatctgaggacacggccgtgtattactgtgcgagactcccgaaagtatagcagctcggcggggngtgtcgacccgtggggccagggacctgtcaccgtctcctcagctccaccgacggcccacgtccggtccttcccccgtcggccacccctcctcccaacgacgccacctcgtcgggggccacgacgccggccctcgggcctcgccgtcggtaccacgggtacctaccttcctaagtactactcgtctgacgcggtcg

SEQ ID NO: 431964 - DNA, 529 bp, Homo sapiens
  misc_feature: GZ8MTXP02G8J5Q.44.43.D10.1.454.CMB.2.raw
  modified_base (348)..(348): a, c, t, g, unknown or other
  modified_base (453)..(453): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatccgaaagtactagcagctcggtcggggnggtggttcgacccgtggggccagggaccctggtcaccgtctcctcacgctccaccaacggcccagtccgtctcccctcggccgccctgctccgagacgcacctcncgggggcacgacgccggcccgtgggcctcggccgtcggtcgaacggctacttccgtatactactgtctgacgcggg

SEQ ID NO: 431965 - DNA, 520 bp, Homo sapiens
  misc_feature: GZ8MTXP02GFPVZ.44.43.D10.1.454.CMB.2.raw
  modified_base (346)..(346): a, c, t, g, unknown or other
tcagacagtatatacacgaccggtgctcgatttagactagcagtaaggggctgaggtgaagaagcctgggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggnggtggttcgaccccgtggggcccaggggaaccctggtcaccgtctcctcagcttccaccaacggcccatcgtctcccctcggcgccctcgctccagacgcacctcgtcgggggcacgacgccggcctcggactcgcctcggtcaacggctactctactactactgtctgagcgg

SEQ ID NO: 431966 - DNA, 514 bp, Homo sapiens
  misc_feature: GZ8MTXP02GP79A.44.43.D10.1.454.CMB.2.raw
  modified_base (349)..(349): a, c, t, g, unknown or other
  modified_base (429)..(429): a, c, t, g, unknown or other
  modified_base (432)..(433): a, c, t, g, unknown or other
  modified_base (435)..(435): a, c, t, g, unknown or other
  modified_base (437)..(437): a, c, t, g, unknown or other
  modified_base (444)..(444): a, c, t, g, unknown or other
  modified_base (446)..(446): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaaacacagcctacatggagctgagcagcctgagatctgaggacacggccgtgtatactgtgcgagactcccgaaagtactagcagctcggtcggggngtgttccgacccgtggggcccaggggaccctgggtccacgtcctctcagctccaccaaggcccatcgctcccctggcccnccnncncncgacgcncncgcggcgacgcgcgccgcggcgcgcgtcgtcgacgactactaactactactactcgtcgtcgacgcgg

SEQ ID NO: 431967 - DNA, 506 bp, Homo sapiens
  misc_feature: GZ8MTXP02GFEO1.44.43.D10.1.454.CMB.2.raw
  modified_base (347)..(347): a, c, t, g, unknown or other
  modified_base (389)..(389): a, c, t, g, unknown or other
  modified_base (417)..(417): a, c, t, g, unknown or other
  modified_base (420)..(420): a, c, t, g, unknown or other
  modified_base (438)..(438): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcggtcggggnggtcggttcgacccctgggggccagggaccctggtcacgtcnctcagctcaccacggccatcgtctcccngcncctgctcagagcactcgnggggcacgcgcggcctgggctcgcctcggtcaacggctaccgttccgtatactactgtactgagtcgg

SEQ ID NO: 431968 - DNA, 543 bp, Homo sapiens
  misc_feature: GZ8MTXP02H9AG0.44.43.D10.1.454.CMB.2.raw
  modified_base (285)..(285): a, c, t, g, unknown or other
  modified_base (343)..(343): a, c, t, g, unknown or other
  modified_base (387)..(387): a, c, t, g, unknown or other
  modified_base (389)..(389): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcacatgacagaacacctcataaacacagcctacatggagctgagcagcctgagatcngaggacacggcgtgtattactgtgcgagactaccgaaagtatagcagctcggcggggngtgggttcgaccccgtggggccacgggacctgtccaccgctccncncgccttccacgacggcccacgtccgtcctccccgtcggccgtcccgtcgcctccgaggcgccaccgtcgtcggggccacgacgccggccgtcggcgtcgccgtcggacgacggtactaccgttaaccgtatacttactcgtctcgtacgccggg

SEQ ID NO: 431969 - DNA, 684 bp, Homo sapiens
  misc_feature: GZ8MTXP02JBYS3.44.43.D10.1.454.CMB.2.raw
  modified_base (186)..(186): a, c, t, g, unknown or other
  modified_base (267)..(267): a, c, t, g, unknown or other
  modified_base (270)..(270): a, c, t, g, unknown or other
  modified_base (287)..(287): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatcgaccaggaacacctcaataaacacagccctaanagngagctagacgcgggacncgtagagatcgaggacggaccgacggtcgtagttacttcgtgtagacgacgtaacgtaccgaagtacgtacgcgacgtcggtcgggtcggggtcgggtccgggtacccggacccggtacggggacccgtaacgggtacccgtcggtacccgtacccgtcctacccgtaccgtaccgtacccgtacccgaacccggtaaccggtcccctaccgttccccgtccccgttcccccgtccgaccccctacccctacccgtaccgaacgacccgtacccgtaccgtccgggtacgggaccaccggtacggtcccggtcccggtcggccgtaccgtccgtacgtaccgtaacgtaccttaaccgttactaagtacgtacgtcgtacgtacggtacggcggtcg

SEQ ID NO: 431970 - DNA, 558 bp, Homo sapiens
  misc_feature: GZ8MTXP02HOUT9.44.43.D10.1.454.CMB.2.raw
  modified_base (347)..(347): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcggtggggnggtggtcgacccctggggccagggaaccctggtcaccgtctcctcacgcttccaccaacgggcccacgtccgtccttcccccgtcggccgccccttcgcctccgacgacgccacctcgtcgggggcacgacgccggcccgtcgggctcggccgtacggtccgaacgggaccttaccgttccgtactaacttaccgtgtcctgtagccgggg

SEQ ID NO: 431971 - DNA, 560 bp, Homo sapiens
  misc_feature: GZ8MTXP02FSXM6.44.43.D10.1.454.CMB.2.raw
  modified_base (394)..(394): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacacagcctacatggagctgagcagcctgagatctgaggacacggccgtgtattactgtgcgagatccgaaagtatagcagctcggtcggggaggtgggttcgacccgtgggggccagggaccctggtcaccgtctcctcngcttccaccaacggcccatccggtccttccccctcggccgccctcgcctcccgaggacgccacctcgtcgggggcacgacgccggcccgtgggccttcgccgtcggtaccgaacgggtcctaccgttccgtaacttactacgttcgttccgttggtacggccgggg

SEQ ID NO: 431972 - DNA, 552 bp, Homo sapiens
  misc_feature: GZ8MTXP02F5RGA.44.43.D10.1.454.CMB.2.raw
  modified_base (348)..(348): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacacagcctacatggagctgagcagcctgagatctgaggacacggccgtgtattactgtgcgagatacccgaaagtatagcagctcggtcggggnggtggttccgaccccgtggggccagggaccctggtcaccgtctcctcagcctccaccaacgggcccacgtccggtccttcccccgtcggccgccccgtcgcctcccgacggacgccgaccgtccgtcgggggccacgacggccggcccgtgggcctcggccgtcggtcgaacggcctactcgtactactactgtctgacggcgg

SEQ ID NO: 431973 - DNA, 542 bp, Homo sapiens
  misc_feature: GZ8MTXP02G71DW.44.43.D10.1.454.CMB.2.raw
  modified_base (256)..(256): a, c, t, g, unknown or other
  modified_base (310)..(310): a, c, t, g, unknown or other
  modified_base (328)..(328): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacncagcctacatggagctgagcagcctgagatctgaggacacggccgtgtattacngtgcgagatccgaaagtntagcagctcgtcggggagtggttccgacccgtggggccaggggaccctggtcaccgtctcctcagccttaccaccaacgggcccactccggtccttcccccgtcggtcccgccctcgcctccgacggacgccgacctcgtcgggggcacgacgccggccctgggctcgccgtcggtcgaacggactactcctactactactgtcgtcgagcggg

SEQ ID NO: 431974 - DNA, 553 bp, Homo sapiens
  misc_feature: GZ8MTXP02G9WTP.44.43.D10.1.454.CMB.2.raw
  modified_base (345)..(345): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatccgaaagtatagcagctcgcggggngtggtcgacccgtggggccagggaccctggtcaccgtctcctcacgcttcaccaacgggcccatccgtccttccccctcggccgccctgcctccgagcgcaccctcgcggggcacgacgccggcccgtcggggcctcggcccgttcgggtccgaaacgggtacctaccgttcccgtaattactacttgtccttcggacggtcccgggg

SEQ ID NO: 431975 - DNA, 592 bp, Homo sapiens
  misc_feature: GZ8MTXP02JMJAC.44.43.D10.1.454.CMB.2.raw
  modified_base (271)..(271): a, c, t, g, unknown or other
  modified_base (350)..(350): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatgganctgagcagcctgagatctgaggacacggccgtgtattactgtgcgagatacccgaaagtatagacagctcggtcggggnggtcggttccgaccccgtgggggcccagggaaccctggcaccgtctcctcacgtctccaccgaacggccctacgtccggttccttcccccgtcggcccgccccgtcgccctcccgacggaccgccgacccgtcggtcgggggccacggacgcccggtcccgtcggggcctcggttccgtcgggtaccgaacgggtaccctacgttccgtaacttacgttaccgtgtccttaggcgccggggg

SEQ ID NO: 431976 - DNA, 526 bp, Homo sapiens
  misc_feature: GZ8MTXP02FQFHM.44.43.D10.1.454.CMB.2.raw
  modified_base (348)..(348): a, c, t, g, unknown or other
  modified_base (391)..(391): a, c, t, g, unknown or other
  modified_base (421)..(421): a, c, t, g, unknown or other
  modified_base (435)..(435): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtactagcagctcgtcggggngtggtccgaccccgtggggccagggaccctggtcaccgtctcncagctcaccaaggccatcgtctccctcgcnccctgctccagacncacctcgtcggggcacgcgccggcccgtgggcctcggacctcggtaccgaacggtacctacgttcccgtatacttactgtcctgacggcgg

SEQ ID NO: 431977 - DNA, 561 bp, Homo sapiens
  misc_feature: GZ8MTXP02GM1SL.44.43.D10.1.454.CMB.2.raw
  modified_base (348)..(348): a, c, t, g, unknown or other
  modified_base (389)..(389): a, c, t, g, unknown or other
  modified_base (394)..(394): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcggtcggggnggtgttcgaccccgtggggccagggaccctggtcaccgtcncctcngcctccaccacggcccagtccgtccttccccctcggccgccctcgcctccgaggaccgcacctcgtcgggggccacgacgccggcccgtcggggcctcggcccgttcgggtaccgaacgggtaccttaccgttcccgtatacttacgtcgtactcggacggtccggg

SEQ ID NO: 431978 - DNA, 557 bp, Homo sapiens
  misc_feature: GZ8MTXP02G5UXY.44.43.D10.1.454.CMB.2.raw
  modified_base (348)..(348): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacacagcctacatggagctgagcagcctgagatctgaggacacggccgtgtattactgtgcgagactccgaaaagtatagcagctcggtcggggngtcggttcgaccccgtgggggcccaggggaaccctggtcaccgtctcctcacgccttccaccgaacgggcccagtccgtccttccccctcggccgccccgtgcctccgacggacgccaccgtcgtcgggggcacgacgccggcccgtcgggctcgccgtcggtcgaaacggacctacgttccgtattactactgtccgtgacgccgggg

SEQ ID NO: 431979 - DNA, 601 bp, Homo sapiens
  misc_feature: GZ8MTXP02HB69R.44.43.D10.1.454.CMB.2.raw
  modified_base (350)..(350): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagactcccgaaagtatagcagcgtcggtcggggnggtcgggttcgaccccgtgggggcccaggggaccctggtccaccgtcctcctcacgtccttccacccgaacgggccccacgtccgtcccttcccccgtcggccgcccctgcctcccgacggacgccaccgtcgtcgggggccacgacgcccggcccgtcgggcctcggcccgtcgggtaccgaaacgggtaccttaaccgttcccgttaactaccgttaccgttacggtccgttacggacggtcccggggg

SEQ ID NO: 431980 - DNA, 572 bp, Homo sapiens
  misc_feature: GZ8MTXP02JEU7E.44.43.D10.1.454.CMB.2.raw
  modified_base (348)..(348): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcggtcggggnggtggttcggaccccgtggggccagggaccctggtccaccgtctcctcacgtcttcccaccgaacgggcccacgtccggtccttcccccgtggtccgcccctcgcctcccgacggacgccgacccgtcgtcgggggccacgacggccggcccgtcggggcctcggcccgtcggtaccgaacgggtaccttacgttccctatacttactgtctcggacggtcggg

SEQ ID NO: 431981 - DNA, 605 bp, Homo sapiens
  misc_feature: GZ8MTXP02HH3X6.44.43.D10.1.454.CMB.2.raw
  modified_base (270)..(270): a, c, t, g, unknown or other
  modified_base (353)..(353): a, c, t, g, unknown or other
  modified_base (488)..(488): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcaataacacagcctacatgganctgagcagccctgagatcgtgaggacacggccgtgtacttacgtgtgacgagactaccgaaagtatagcagtctcggtggggnggttcggttccgaccccggtggggacccacggggaaccctggtcctaccgtccctcctcgacgtccttacccgaccgaacgggcccctacgtcccgtccttcccccgtcggcccgcccgtcgcctccgacggacnccgtaccgtcggtcggggccacgcgccggtcccgtgggcctcggccgttcggtaccgaacggtaccttaccgttaaccctagttaacgttaccgtggtaccgtaggtacggccgggg

SEQ ID NO: 431982 - DNA, 723 bp, Homo sapiens
  misc_feature: GZ8MTXP02HYUFX.44.43.D10.1.454.CMB.2.raw
  modified_base (266)..(266): a, c, t, g, unknown or other
  modified_base (284)..(284): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaacctacagtgtaacacagctatgcacagaagttccagggcagagtcaccatgaccaggaacacctcataaacacagcctacatgganctgagcagcctgagatcngaggacacggccgtgtattactgtgcgagtactaccgaaagtatagacagtcgtcgggtcggggagggtttcgggttccggaaccccccggttggggggacccctaacgggggtaaaacccccgttcggggtacccgtaacccggtcccgtcccgttacccgacgtacccgtttacccccgaacccggtaacccgggacccccgtaaccgttcccggttccccgttccccccgtccgggtcccgtcccccgttccgcccgttacccggacgggacgacccgtaccccgttccggtcgggggacccgaccggtaacggccccggggtccccggtccggggtcccgtccggtcccgtacgggttacccgaaacgggtaacccttacccgttaaccttaacgttacttaccgttacgtacccgtttggtaacggtcccgggg

SEQ ID NO: 431983 - DNA, 569 bp, Homo sapiens
  misc_feature: GZ8MTXP02JPNXG.44.43.D10.1.454.CMB.2.raw
  modified_base (256)..(256): a, c, t, g, unknown or other
  modified_base (270)..(270): a, c, t, g, unknown or other
  modified_base (330)..(330): a, c, t, g, unknown or other
  modified_base (348)..(348): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgcaggccactggacaagggcttgagtggatgggatggatgaaccctaacagtggtaacacaggctatgcacagaagttccagggcagagtcaccatgaccaggaacacctccataaacncagcctacatgganctgagcagcctgagatctgaggacacggccgtgtattactgtgcgagactcccgaaagtntagcagctcggtcggggnggtggttcgaccccgtgggggccagggaaccctggtccaccgtctcctcagctccaccaggccccatccgtcttccccctggccgcccctgcctccaggacgcgaccgtcgtcgggggcaccgacgcccggccccgtggggccttcggcccgttgggtccgtaacgggtaccttaacgttccccgtaattacgtaccttcgtcgttacggacgtccggggg

SEQ ID NO: 431984 - DNA, 592 bp, Homo sapiens
  misc_feature: GZ8MTXP02HCSVN.44.43.D10.1.454.CMB.2.raw
  modified_base (269)..(269): a, c, t, g, unknown or other
  modified_base (287)..(287): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgacaggaacactccataaacacagcctacatgganctgagcagcctgagatcngaggacacggcctagtattacgtgtgcgagactaccgaaaagtactagcagcgtcggcggggtaggtcggttcgaccccgtggggccgacgggaaacccttggtccaccgtcctcctcacgccttacccacccgtaacggccccaacgtccgttcccgttcccccgtcggcccgtccccgttcgcctcccgaggaccgccaccgtcggtcgggcacgacgcccgcccgtcgggcctcgccgtacggtcgaacggtaccttaccgttccgtaacttacttactcgtcgtacggtacggtcccgggg

SEQ ID NO: 431985 - DNA, 536 bp, Homo sapiens
  misc_feature: GZ8MTXP02GG2EO.44.43.D10.1.454.CMB.2.raw
  modified_base (271)..(271): a, c, t, g, unknown or other
  modified_base (346)..(346): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatgganctgagcagcctgagatctgaggacacggccgtgtattactgtgcgagatccgaaagtatagcagctcgtcggggngtggtcgacccgtggggccagggaccctggtcaccgtctcctcacgcttccaccaacgggcccagtccgtccttcccccgtggccgccctcgcctccgacgacgcgaccgtcgtcgggggcacgacgccggcccgtcgggctcggcctcgggtcaacggctacgtccgtactactactgtctgacgcggg

SEQ ID NO: 431986 - DNA, 601 bp, Homo sapiens
  misc_feature: GZ8MTXP02ICMEG.44.43.D10.1.454.CMB.2.raw
  modified_base (187)..(187): a, c, t, g, unknown or other
  modified_base (271)..(271): a, c, t, g, unknown or other
  modified_base (289)..(289): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctaatgcacagaagttccagggcagagtcaccatgacaggaacacctcaataaacacagcctacatgganctgagcagcctgagatcngagacacggcgtgtattactgtgcgagactaccgaaaagtactaagcagcgtacggtcggggagtcggttaccgacccccgtgggggaccccaggggaacccctgggtacctacccgtctccctcgacgtcccttcccaaccgaacgggccccacgttcccggtcccttcccccgtcggcccgccccttcgcctcccgaggacgccgacccgtcgcgggggccacgacggccggtcccgtcgggccgcgccgtcggttaccgaacggtaccttaccttaaccgttaactataccgtggtcctggacgccggg

SEQ ID NO: 431987 - DNA, 583 bp, Homo sapiens
  misc_feature: GZ8MTXP02GWN6X.44.43.D10.1.454.CMB.2.raw
  modified_base (285)..(285): a, c, t, g, unknown or other
  modified_base (289)..(289): a, c, t, g, unknown or other
  modified_base (348)..(348): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctganatcngaggacacggccgtgtattactgtgcgagactccgaaagtatagcagctcggtcggggnggtggtcggaccccgtggggcccaggggaccctggtcaccgtctcctcacgccttcccaccgaacgggcccctagtccgtccttcccccgtcggccgcccctcgccctccgacgggcgccacccgtcgtcgggggccacgacggcccgggcccgtcggggcctcggcccgtcggtccgaacgggtaccttaccgttaaccgttactacgttacctcgtcgtcgtacggtccgggg

SEQ ID NO: 431988 - DNA, 584 bp, Homo sapiens
  misc_feature: GZ8MTXP02G50SF.44.43.D10.1.454.CMB.2.raw
  modified_base (271)..(271): a, c, t, g, unknown or other
  modified_base (285)..(285): a, c, t, g, unknown or other
  modified_base (352)..(352): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatgganctgagcagcctganatctgaggaccacggccgtgtacttacgtgtgcgagactaccgaaagtatagcagctcggtcggggngtcgggttcgacccccgtgggggcccacggggaccctcggtccgacccgtcctccctcacgccttccaccgaacggcccacgtccggtcccttcccccgtcggcccgccccgtcgccctccgacggaccgccgacccgtcgtcgggggcaccgacgcccggcccgtcgggctcggccgtcggtaccgaacggtaccttacgttcctatactactgtcgtcggacggtccggg

SEQ ID NO: 431989 - DNA, 548 bp, Homo sapiens
  misc_feature: GZ8MTXP02H2FNT.44.43.D10.1.454.CMB.2.raw
  modified_base (267)..(267): a, c, t, g, unknown or other
  modified_base (282)..(282): a, c, t, g, unknown or other
  modified_base (285)..(285): a, c, t, g, unknown or other
  modified_base (340)..(340): a, c, t, g, unknown or other
  modified_base (437)..(437): a, c, t, g, unknown or other
tcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcacatgacaggaacactccataaacacagcctacatgganctgagcagcctgagntcngagacacggcgtgtattactgtgcgagactccgaaatatagcagctcggtggggngtcggttcgaccccgtggggaccacgggaaccctgtccacccgtctccctcgacgccttaccaccgaaacgggcccacgtccggtcctttcccccgngccgtcccgtgaccgtccgagacgccgaccgtcgcggggcacgacgcccgccgcggctcgccgtcggtacaacggacttactccgtatactaccgtgtccgtagacgccgg

SEQ ID NO: 431990 - DNA, 606 bp, Homo sapiens
  misc_feature: GZ8MTXP02G90VQ.44.43.D10.1.454.CMB.2.raw
  modified_base (257)..(257): a, c, t, g, unknown or other
  modified_base (271)..(271): a, c, t, g, unknown or other
  modified_base (353)..(353): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacncagcctacatgganctgagcagcctgagatcgtgacggacacggccgtgtattactgtgcgagactaccgaaaagtatagcaggctcggtcggggngtcggtccggaccccgtggggccgacggggacccctggtccgacccgtcctccctcgacgtcccttacccacccgaacggccctacgtcccgtcccttcccccgtcggtcccgccccgtcgccctaccgacggacgccgaccgtccgcgggggccacgacggcccggcccgtcggggctcggtccgtcggtaccgtacgggtaccttaccgttaaccgtacttacgtaccgtcgtcgtacggacggtccgggg

SEQ ID NO: 431991 - DNA, 630 bp, Homo sapiens
  misc_feature: GZ8MTXP02HHYAV.44.43.D10.1.454.CMB.2.raw
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtacttactgtgcgagactccgaaagtatagcagctcggtcggggaggtcggttcgacccccggtggggccacggggaacccgtggtccgaccgtcctccctcgacgtccttacccgacccaacggggccccagtccggtccttcccccgtcggcccgtcccctcgccctcccgacggaccgccgacccgttccggcgggggccaccgacggcccggtccccgtcggggtccctcggcccggtacgggttcccgaaacgggtacccttaacccggtttaacccgtaagttaaccttaccgttcgttaccgttcgacgggtcccgggg

SEQ ID NO: 431992 - DNA, 573 bp, Homo sapiens
  misc_feature: GZ8MTXP02HMQ6B.44.43.D10.1.454.CMB.2.raw
  modified_base (271)..(271): a, c, t, g, unknown or other
  modified_base (362)..(362): a, c, t, g, unknown or other
  modified_base (471)..(471): a, c, t, g, unknown or other
  modified_base (511)..(511): a, c, t, g, unknown or other
  modified_base (563)..(563): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatgganctgagcagccctgacgatctggacggacacgggcccgtgtactttaacctgtgtactagactacccgaaagtatagcagctcggtcggggnggtggtccgaccgtcggggccgagggaccctggccaccgtctcctcgactctccaccgacggcccatccggtccttccccgcggtcctccccgtcgcctccgacggacnccgaccgtcggtcggggctacgacgcccggccgtcgggcnccggtccgtacggtccaacgggtacctaccgttcgtactacttactgtaccngtacggcggg

SEQ ID NO: 431993 - DNA, 566 bp, Homo sapiens
  misc_feature: GZ8MTXP02F8E81.44.43.D10.1.454.CMB.2.raw
  modified_base (256)..(256): a, c, t, g, unknown or other
  modified_base (284)..(284): a, c, t, g, unknown or other
  modified_base (355)..(355): a, c, t, g, unknown or other
  modified_base (408)..(408): a, c, t, g, unknown or other
  modified_base (458)..(458): a, c, t, g, unknown or other
  modified_base (558)..(558): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacncagcctacatggagctgagcagcctganatcgtagaggacacggccgtagtacttactgtgcgagactaccgaaagtactagcagcgtacggtcggggnggtcgggtcgaccccggtggggcccgaagggaccctggtcgaccgtctcctcncgcccttccaccgaacggcccacgttacccgtccttccccctcgggcccnccccgttcgcccgtccgacggaccgccgaccgtcggtcggggcaccgacgccgcccgtcggctcgccgtcgtcgaacggctactcctatactactgtccngtacgcgg

SEQ ID NO: 431994 - DNA, 551 bp, Homo sapiens
  misc_feature: GZ8MTXP02GEE7G.44.43.D10.1.454.CMB.2.raw
  modified_base (272)..(272): a, c, t, g, unknown or other
  modified_base (351)..(351): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaaacacagcctacatgganctgagcagcctgagatctgaggacacggccgtgtattactggtgcgagactaccgaaagtatagcagctcggtcggggnggtcggttcgaccccgtgggggcccaggggaaccctggtccaccgtctcctcagccttaccaccaagggccccagtccgtccttcccccgtggccgccctgcctccgagcgcacctcgcggggcacgcgtccggcccgtgggctcgaccgtcggtacgaacggtcctacgttcccgtatactactgtcctggacgccggg

SEQ ID NO: 431995 - DNA, 556 bp, Homo sapiens
  misc_feature: GZ8MTXP02HSXQF.44.43.D10.1.454.CMB.2.raw
  modified_base (252)..(252): a, c, t, g, unknown or other
  modified_base (275)..(275): a, c, t, g, unknown or other
  modified_base (348)..(348): a, c, t, g, unknown or other
  modified_base (455)..(455): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccanaaacacagcctacatggagctgngcagcctgacgatctgaggacacggccgtgtattactgtgcgagatcccgaaagtatagcagctcggtggggnggtgggttcgaccccgtggggaccacgggaaccctggtccaccgtctcctcagccttccaccgtaacgggcccacgtccgtccttccccctggccctacccgtcccnccctaacgacgcacccgtcgtcggggcacgacgccgcccgtcggctggccctggtcaacgggtcctaccgttcctaatactacgtctcgtcgacgtcggcg

SEQ ID NO: 431996 - DNA, 674 bp, Homo sapiens
  misc_feature: GZ8MTXP02JOQ5C.44.43.D10.1.454.CMB.2.raw
  modified_base (247)..(247): a, c, t, g, unknown or other
  modified_base (257)..(257): a, c, t, g, unknown or other
  modified_base (265)..(266): a, c, t, g, unknown or other
  modified_base (270)..(270): a, c, t, g, unknown or other
  modified_base (272)..(272): a, c, t, g, unknown or other
  modified_base (275)..(275): a, c, t, g, unknown or other
  modified_base (346)..(346): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacgaggctatgcacagaacgttccgagggcagagtcaccatcgacagaacncctcataacncagctacnnggancngancagcctgacgatccgtaggaggaccgtacggccgttaggttacttacgtgtgacgagacttaccgaaagtntacgcagcgtcgggcggggtggtcggtccggacccgtgggggacccgacgggacccttgggacctacccgtccctaccgctacgtcccgtaccgacccggaacggtaccccctagtccccggttccccttcccccgtgggcccctccccgtcgccgtcccgaacggaccgcccgacccgttcggtccgggggaccaccgggacgccccggggtacccgtcggggccttaccggccgttacggggtaccgaaaaccgggttaccccttacctttaacccgtaagttaaccgttaccggtcgttacccggttggggaccgtacccggggg

SEQ ID NO: 431997 - DNA, 576 bp, Homo sapiens
  misc_feature: GZ8MTXP02IBXRC.44.43.D10.1.454.CMB.2.raw
  modified_base (258)..(258): a, c, t, g, unknown or other
  modified_base (272)..(272): a, c, t, g, unknown or other
  modified_base (286)..(286): a, c, t, g, unknown or other
  modified_base (290)..(290): a, c, t, g, unknown or other
  modified_base (311)..(311): a, c, t, g, unknown or other
  modified_base (318)..(318): a, c, t, g, unknown or other
  modified_base (351)..(351): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccagaaccacctccaataaacncagcctacatgganctgagcagcctganatcngaggacacggcgtgtattacngtgcganactaccgaaagtactagcagcgtcggtcggggngttcggttccgacccccggttggggcccgaacgggaccctggtcccacccgtctcctcgacgtccttcccgaccgaacgggccctacgtcccgtcccttcccccgtggccctcccgttcgcccttccgacggctcccgaccgttcggcggggaccacgcggccggcccgtggctcgccgtagtccgaacgtacctacgttccgatactctcgtctagcggtcggg

SEQ ID NO: 431998 - DNA, 615 bp, Homo sapiens
  misc_feature: GZ8MTXP02F6KVI.44.43.D10.1.454.CMB.2.raw
  modified_base (187)..(187): a, c, t, g, unknown or other
  modified_base (318)..(318): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcggcaggccactggacaagggcttgagtggatgggatggatgaaccctaanagtggtaacacaggctatgcacagaagttccagggcagagtcacatgaccaggaacacctccaataaacacagcctacatggagctgagcagcctgagatctgaggacacggccgtgtattactgtgcganataccgaaagtatagcagctcggtcggggagggtggttccggacccccgtgggggacccgtaacgggggaaacccctgggtcccgaccgttcctcccgtcgacgtccttacccacccgaacgggcccctaacgtcccggttcctttcccccgcggtcccgtccccgtcgcccgttaccgaggaccgccaccgtccggtcggggccaccgacggccggccccgtcgggcctcgccgtacggtaccgaaacggtacctaccttcccgtaactacgtacttcggtcctaggacggccggg

SEQ ID NO: 431999 - DNA, 590 bp, Homo sapiens
  misc_feature: GZ8MTXP02G443U.44.43.D10.1.454.CMB.2.raw
  modified_base (187)..(187): a, c, t, g, unknown or other
  modified_base (259)..(259): a, c, t, g, unknown or other
  modified_base (353)..(353): a, c, t, g, unknown or other
  modified_base (358)..(358): a, c, t, g, unknown or other
  modified_base (471)..(471): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatgaccaggaaccacctccaataaacncagcctacatggagctgagcagcctgagatcgtggacggaccacggccgttagtattacgtgtgacgagactaccgaaagtatagcagctcggnggggngttcggtccgacccgtggggccgaggggaccctggtccacgtcctcctcacgccttccaccgacggcccacgtccgtccttccccgtcggccgcccgtcgcctccgacggacnccgtaccgtcggtcggggccacgacggcccggtcccgtcgggctcggccgtggtacccgaacggtaccttaccttaaccgtactacgttacccgtggtaccgtacggacggtcccgggg

SEQ ID NO: 432000 - DNA, 682 bp, Homo sapiens
  misc_feature: GZ8MTXP02JBGSZ.44.43.D10.1.454.CMB.2.raw
  modified_base (187)..(187): a, c, t, g, unknown or other
  modified_base (398)..(398): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccgagggcagagtcaccatgaccaggaacacctcaataaacacacgaccacatggagctgagcagcctagagatcgtggaagacgaccggcgtagttaattactggtgacgacgatacccggtaaaagtgtaacgcaaggtcgttacgggtcggggagggtcgttcccgggtaaccccgggnggggacccgaacgggggaaacccccttgggtacccgtacccgtccgttcccgtctacgtcccttacccgaaccccgaacgggtacccctacgtcccgttccgttccccccgtcgggcccgccccgttcgcctacccggacggaaccgtcccgacccgttcggccggggaccgaacgccgggcccggccccggtcggtcccggccgtaccggtacggtaccgaaaccgtaccgtttaacccttccgttaaactacgttaccctggtaccgtacggacggtccggg

SEQ ID NO: 432001 - DNA, 541 bp, Homo sapiens
  misc_feature: GZ8MTXP02JK9Y8.44.43.D10.1.454.CMB.2.raw
  modified_base (273)..(273): a, c, t, g, unknown or other
  modified_base (360)..(360): a, c, t, g, unknown or other
  modified_base (408)..(408): a, c, t, g, unknown or other
  modified_base (529)..(529): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaaccacctccaataaacacagcctacatgganctgagcagccctgagatcgtggaggacaccggtccgtgtaacttactgtcgcgagactaccgaaagtatagcagcgtcggtcggggnggttcggtcgccccggtggggccgacgggacctggtccacgtctctcnctcctcaccgacgccctagtccgtccttccccgtcgccgtccctgcctcgacgacgccaccgtcgcgggcacgcgccggccgtggcgtcgacgtcgacgacggtctacgtctatctacgtntcgtgcggtcgg

SEQ ID NO: 432002 - DNA, 530 bp, Homo sapiens
  misc_feature: GZ8MTXP02FNYHV.44.43.D10.1.454.CMB.2.raw
  modified_base (187)..(187): a, c, t, g, unknown or other
  modified_base (256)..(256): a, c, t, g, unknown or other
  modified_base (264)..(264): a, c, t, g, unknown or other
  modified_base (270)..(270): a, c, t, g, unknown or other
  modified_base (272)..(272): a, c, t, g, unknown or other
  modified_base (284)..(284): a, c, t, g, unknown or other
  modified_base (308)..(308): a, c, t, g, unknown or other
  modified_base (315)..(315): a, c, t, g, unknown or other
  modified_base (328)..(328): a, c, t, g, unknown or other
  modified_base (331)..(331): a, c, t, g, unknown or other
  modified_base (344)..(344): a, c, t, g, unknown or other
  modified_base (519)..(519): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaanagtggtaacacaggctatgcacagaagttccagggcagagtcaccatgaccaggaacacctcataaacncagcctanatggancngagcagcctgantctgagacacggccgtgtattacngtgcganactccgaaaagtnagnagtctcgcggggngtcggttcgacccgtggggcccagggaccctgtcacgtctacgtcacgcttaccaccgaacggcccagtccggtccttccccctggccaccctgcctccgagacgcacctcgcggggcacgagccgcctgggcctgccgttcggcaaggacctactaaccctataactcctcgtnttcgacgcggg

SEQ ID NO: 432003 - DNA, 740 bp, Homo sapiens
  misc_feature: GZ8MTXP02IJU2P.44.43.D10.1.454.CMB.2.raw
  modified_base (303)..(303): a, c, t, g, unknown or other
tcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacgaggctatgcacagaagttccgagggcagagtcaccatcgaaccaggaaccaccctacaataaacacacgccctacaagtggacgctagagccaagccgtagagntactggaacggaccgacgggccgttagttactttacgtcggtgacgacgtaactacccgaaaagtacgtagcacggtcgtcgggtacggggtgggttccggtccggtaccccggtcggggacccgtacggggaacccgtcggggtccacccgtccttcccgtcgaccgtacccttaccccgaacccggtaaccggtccctaccggttccgtccccgttaccccccgttcggggcccctacccccggtcgtcccgtaccggtaaacggacccgtcccgtaaccgttccgggggtacgggaccaccgggtacggtcccccgggtacccgttcgggggccgttccgggtacccggtacggttaacccggaaaacgttaccgtttaacccttccctaaacgtttaccgtacgttacgtccggtttacggacgtcccggggg

SEQ ID NO: 432004 - DNA, 531 bp, Homo sapiens
  misc_feature: GZ8MTXP01CTG7A.38.38.D05.1.454.CMB.2.raw
  modified_base (267)..(267): a, c, t, g, unknown or other
  modified_base (504)..(504): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaatcatcatttangacgtcactcatcggccctcaggggtttctactcgcttctctggctccaagtttggcaacacggcctcctgaccccatttctgggctccaagggctgaggacgagggctgaatttttatgcttcctcatatacaggcagcagcacccttatgtcttcggggaactgggaccaaggtccaccgtctacgtcagcccaaggccaacccaactcgttcacttctcgttccccgccttccncaacgtgaactcgacttgaagcgggtc

SEQ ID NO: 432005 - DNA, 570 bp, Homo sapiens
  misc_feature: GZ8MTXP01C280R.38.38.D05.1.454.CMB.2.raw
  modified_base (264)..(264): a, c, t, g, unknown or other
  modified_base (283)..(283): a, c, t, g, unknown or other
  modified_base (385)..(385): a, c, t, g, unknown or other
  modified_base (389)..(389): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctctgtaccaacaacacccaggcaaagccccaaatcatcatttangacgtcactcatcggcctnagggtttctactcgcttctctggctccaagtttggcaacacgcctcctgaccccatttctgggctccaaggctgagacgaggctgaattttatcgctcctanatanacgagacagcacgacctacccttatcgtacgttacggggaacgtacgggaacctaacggtcctaccgtccgtacgtaccacgacccaacgaccccaaccctaactcgttacctaccttccgtccgttccccacccttccgttactaaccgtctaacgtcgacgttacgtaacggcgggtcg

SEQ ID NO: 432006 - DNA, 530 bp, Homo sapiens
  misc_feature: GZ8MTXP01CL6HV.38.38.D05.1.454.CMB.2.raw
  modified_base (269)..(269): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgcccccaaactcatcatttangacgtcactcatcggccctcaggggtttctactcgcttctctgctcaagtttggcacacggcctccctgaccccatttctgggctccgaagctgaggacgaggctgaattttatgctctcatatacaggcagcagcaccccttatgtcttcggggaactgggaccaaggtcaccgtctacgtcacgcccaaggcccaaaccccaactcgttcacttctcgttcccacccttcttcaacgtgaactcgacttgaacgcggcg

SEQ ID NO: 432007 - DNA, 536 bp, Homo sapiens
  misc_feature: GZ8MTXP01BQILH.38.38.D05.1.454.CMB.2.raw
  modified_base (268)..(268): a, c, t, g, unknown or other
  modified_base (392)..(392): a, c, t, g, unknown or other
  modified_base (477)..(477): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaagcccccaaactcatcatttangacgtcactcatcggccctcaggggtttctactcgcttctctggctcaagtttggcaacacggcctccctgaccccatttctggggctccgaaggctgaggacgaggctgaattttatgctctnatatacaggcagcagcaccccttatgtcttcggggaactgggaccaggtccaccgtcctacgtcagccccaaggcccaaaccccnctcgttccacttctcgttccccacccttccttcaacgtgaactcgacttgcgcgggtcg

SEQ ID NO: 432008 - DNA, 527 bp, Homo sapiens
  misc_feature: GZ8MTXP01AXHWM.38.38.D05.1.454.CMB.2.raw
  modified_base (269)..(269): a, c, t, g, unknown or other
  modified_base (478)..(478): a, c, t, g, unknown or other
  modified_base (502)..(502): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttangacgtcactcatcggccctcaggggtttctactcgcttctctggctccaagtttggcaacacggcctccctgacccctatttctgggctccgaaggctgggggacaggctgtaattttatgctcctcatatacaggcagcagcaccccttatcgtcttcggaacgtcgggacaaggtcaccgtcctacgtcacgcccaagcccaacccntcgtcactcttcgtcccaccttcncacgtgatcgactgagtcggcgtgg

SEQ ID NO: 432009 - DNA, 538 bp, Homo sapiens
  misc_feature: GZ8MTXP01CBM41.38.38.D05.1.454.CMB.2.raw
  modified_base (268)..(268): a, c, t, g, unknown or other
  modified_base (349)..(349): a, c, t, g, unknown or other
  modified_base (498)..(498): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaatcatcatttangacgtcactcatcggccctcaggggtttctactcgcttctctggctccaagtttggcacacggcctcctgaccccatttcngggctccaaggctgaggacgagctgattttatgctctcatatacaggcagctagccacccttatcgtcttacggggaactggggaccaaggtcacccgtctacgtcacgcccgaaggcccaaacccgctcgcaccttctcggttccccncccttccttcgaacgttgaactccgattcgaacgcgggcg

SEQ ID NO: 432010 - DNA, 536 bp, Homo sapiens
  misc_feature: GZ8MTXP01COXC2.38.38.D05.1.454.CMB.2.raw
  modified_base (269)..(269): a, c, t, g, unknown or other
  modified_base (350)..(350): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgcccccaaactcatcatttangacgtcactcatcggccctcaggggtttctactcgcttctctggctccaagtttggcacacggcctcctgaccccatttcngggctccaaggctgaggacgagggctgaattttatgctctcatatacaggcagcagcaccccttatgtcgttcggggaacttggggaccaaggtccaccgtcctacgtcacgcccaaggcccaaccccgctcgttcacttctcgttcccacccttccttcaactgaactcgacttgaacgcgggtc

SEQ ID NO: 432011 - DNA, 515 bp, Homo sapiens
  misc_feature: GZ8MTXP01D8J6K.38.38.D05.1.454.CMB.2.raw
  modified_base (233)..(233): a, c, t, g, unknown or other
  modified_base (291)..(291): a, c, t, g, unknown or other
  modified_base (350)..(350): a, c, t, g, unknown or other
  modified_base (356)..(356): a, c, t, g, unknown or other
  modified_base (378)..(378): a, c, t, g, unknown or other
  modified_base (464)..(464): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccagcaaagtcccaaactcataattatgagtcactaaacgcctnaggatttctaatcgcttctctggctctaagtttgcaacacggcctccccctgacattcnggctcnggctgagacgagctgtaatttntgctctcatatacagcagcagccacccttatggtacttcggaactgggaccaaggtcaccgtctacgcacgcccaagcccaacccntcgttcacttcttcgttccccgcctcctcaacgtgattccgaacttgaacg

SEQ ID NO: 432012 - DNA, 244 bp, Homo sapiens
  misc_feature: GZ8MTXP01A4SRV.38.38.D05.1.454.CMB.2.raw
  modified_base (242)..(244): a, c, t, g, unknown or other
tcagtcgatcacgtcacgaccggtgctcgatttagtatctgatagttgggtttggtggtctccactcccgccttgacgaggctgaattttattgctcctcatatacaggcagcagcaccccttatgtcttcggaactgggaccaaggtcaccgtcctacgtcagcccaaggccaaccccactgtcactctgttcccaccctcctcacgtgatcgactgagcgggctgggcaaggcgcatagnnn

SEQ ID NO: 432013 - DNA, 548 bp, Homo sapiens
  misc_feature: GZ8MTXP01CSUO8.38.38.D05.1.454.CMB.2.raw
  modified_base (271)..(271): a, c, t, g, unknown or other
  modified_base (356)..(356): a, c, t, g, unknown or other
  modified_base (512)..(512): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggacaaacgcccccaaactcatcatttangacgtcactcatcggcccctcaggggtttctactcgcttctctggctccaagttttggcaacacggcctccctgaccccatttcngggctccaaggctgaggacgaggctgaattttatgctctcatatacaggcagcacgcacccttatgtcttcggggaacgtgggaccaagggtccaccgtcctacgtcacgcccaaacggcccaaaccccgctcgttcctaccttcgtcgttccccncccttccttcaacgtgaactcgacttgcgttcggcg

SEQ ID NO: 432014 - DNA, 554 bp, Homo sapiens
  misc_feature: GZ8MTXP01CH3PJ.38.38.D05.1.454.CMB.2.raw
  modified_base (227)..(227): a, c, t, g, unknown or other
  modified_base (261)..(261): a, c, t, g, unknown or other
  modified_base (306)..(306): a, c, t, g, unknown or other
  modified_base (389)..(389): a, c, t, g, unknown or other
  modified_base (428)..(428): a, c, t, g, unknown or other
  modified_base (457)..(457): a, c, t, g, unknown or other
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaancagtagtgactagttggtggttataactatgtcnctggtaccaacaacaccaggacaaagccccaaactcatcatttangacgtcactcatcgcctcagggtttctacctcgcttctctggcctctaagtttggcaaacaccggcctcctgacctatttcgnggctcagctgagacgaggctagtaatttatcgtctcctnaatatacgagcagcacgtcctaacccttntcgtccttacggaacttcgggaccgtaaaggtccttacccggttccttaccggttaacacgaaccccaacggccccaaacccgtccttcgttaaccc

SEQ ID NO: 432015 - DNA, 528 bp, Homo sapiens
  misc_feature: GZ8MTXP01BUDOK.38.38.D05.1.454.CMB.2.raw
  modified_base (268)..(268): a, c, t, g, unknown or other
  modified_base (350)..(350): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttangacgtcactcatcggccctcaggggtttctactcgcttctctggctccaagtttggcacacggcctccctgaccccatttcngggctccaaggctgagacgaggctgtaatttatgctcctcatatacaggcagcagcacccttatgtcttcgggaactggggaccaggtcaccgtccacgtcacgcccaaggcccaacccaactcgcaccttcgtcgtccccacccttccttcaacgtgctcgacttcgaacggcggcg

SEQ ID NO: 432016 - DNA, 535 bp, Homo sapiens
  misc_feature: GZ8MTXP01CCSNE.38.38.D05.1.454.CMB.2.raw
  modified_base (268)..(268): a, c, t, g, unknown or other
  modified_base (288)..(288): a, c, t, g, unknown or other
  modified_base (507)..(507): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaatcatcatttangacgtcactcatcggccctnagggtttcactcgcttctctggctccaagtttggcaacacggcctccctgacccccatttctgggctccaaggctgaggacgaggctgaattttatgctctcatatacaggcagcagcaccccttatgtcttcggggaactggggaccaaggtcaccgtctacgtcagcccaaggcccaaacccgaactcgttcaccttctacgttccccacccttccncaacgtgaactcgacttgaacgcgggcg

SEQ ID NO: 432017 - DNA, 437 bp, Homo sapiens
  misc_feature: GZ8MTXP01CW7J4.38.38.D05.1.454.CMB.2.raw
  modified_base (286)..(286): a, c, t, g, unknown or other
  modified_base (362)..(362): a, c, t, g, unknown or other
  modified_base (428)..(437): a, c, t, g, unknown or other
tcagtcgatcacgtcacgaccggtgctcgatttagtatctgatagttgggtttgggggctttgcctgggtgttgttggtaccagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgtaattttatgctcctcatanacaggcagcagccaccccttatgtcttcggaactgggaccaaggtcaccgtctacgtcagcccaagcccaaacccnctcgcactctcgttccccgccctcctcacgtgatccgactggagcgggctggcgaagcgacatagnnnnnnnnnn

SEQ ID NO: 432018 - DNA, 539 bp, Homo sapiens
  misc_feature: GZ8MTXP01BX9D5.38.38.D05.1.454.CMB.2.raw
  modified_base (266)..(266): a, c, t, g, unknown or other
  modified_base (512)..(512): a, c, t, g, unknown or other
  modified_base (519)..(519): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaagccccaaatcatcatttangacgtcactcatcggccctcagggtttctactcgcttctctggctccaagtttggcaacaccggcctccctgacccctatttctgggcctccgaaggctggaggacgaggctagtaatttatgctctcatatacagcagcagccacccttatcgtcttcggggaaacttgggaacctaaggtccaccggtcctacgtcacgcccaacggcccaacccaactgttccacttctcgtcccgcccttcncaacgtnaactcgacttgcgcgggtcg

SEQ ID NO: 432019 - DNA, 538 bp, Homo sapiens
  misc_feature: GZ8MTXP01B4IAN.38.38.D05.1.454.CMB.2.raw
  modified_base (225)..(225): a, c, t, g, unknown or other
  modified_base (307)..(307): a, c, t, g, unknown or other
  modified_base (393)..(393): a, c, t, g, unknown or other
  modified_base (447)..(447): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagtagtgactagtttggtggttataactatgtctcctggtaccaacaacacccaggcaaacgcccccaaatcatcatttangacgtcactcatcgccctcgaggggtttctacctcgcttctctgctcctaagtttggcaacacggtcctccctgaccctatttcgngggctccgaggctaggaggacgagggctagtaattttatcgcttctcatatacnggcagcagtcctacccttatcgtctcggaactgggacctaaggtccaccgttccttacgtcacgcccgaacggcccaacccgtcttcgtcc

SEQ ID NO: 432020 - DNA, 535 bp, Homo sapiens
  misc_feature: GZ8MTXP01BYS48.38.38.D05.1.454.CMB.2.raw
  modified_base (269)..(269): a, c, t, g, unknown or other
  modified_base (352)..(352): a, c, t, g, unknown or other
  modified_base (515)..(515): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttangacgtcactcatcggccctcaggggtttctactcgcttctctggctccaagtttggcaacacggcctccctgaccccatttcngggctccaagctgaggacgaggctgtaatttatgctcctcatatacaggcagcagccaccccttatgtcttcggggactgggaccaggtccaccgtccacgtcacgcccaacggcccaaccccaagtcgttcacgttctcgttcccacccttccttcaacgtnaactcgacttgcgcgggtcg

SEQ ID NO: 432021 - DNA, 529 bp, Homo sapiens
  misc_feature: GZ8MTXP01DDDVN.38.38.D05.1.454.CMB.2.raw
  modified_base (267)..(267): a, c, t, g, unknown or other
  modified_base (507)..(507): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaagccccaaactcatcatttangacgtcactcatcggccctcaggggtttctactcgcttctctggctccaagtttggcaacacggcctcctgaccccatttctgggctccaaggctgaggacgaggctgaatttatgctctcatatacaggcagcagcaccccttatgtcttcggggaactgggaccaaggtcaccgtctacgtcacgcccaacggcccaacccaactcgttcacttctcgtcccacccttccttcaacgngaactcgacttgaacgcggtcg

SEQ ID NO: 432022 - DNA, 629 bp, Homo sapiens
  misc_feature: GZ8MTXP01CD5H2.38.38.D05.1.454.CMB.2.raw
  modified_base (190)..(190): a, c, t, g, unknown or other
  modified_base (268)..(268): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgactattggtgttataactatgtctcctgtaccaacaacacccaggcaaaacgccccaaactcatcattangacgtcactcatccggccctcgtagggtttcctactccgtcttctctggtctacctaagtttcggacaacaccggcctccctgtaccccctatttcgtcgggcctcccgaaggcctgagggacgtaggtctagtaattttatgtcttctacatatacaggcacgacacgcctaccccttatcgttaccgttacggggaacgttcggggaacctaacgggtcctacccggtcctacgtaccacgaccccaacggccccaaacccaactcgttacctaccttccgttcccgtccccttaccccgttccttaccgtaaccgttacgaaccgttcggaccgttcgggtaaccggccgggtccggg

SEQ ID NO: 432023 - DNA, 564 bp, Homo sapiens
  misc_feature: GZ8MTXP01DHVVF.38.38.D05.1.454.CMB.2.raw
  modified_base (314)..(314): a, c, t, g, unknown or other
  modified_base (440)..(440): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaagcagtagtgaactagtttggtggttataactatgtctcctggtaccaaacaacacccaggaccaaagcccccaaaactcatcattttangacgtcactcatcggccctcaggggtttcctacctcgcttctctgctcaagttgcaacacggcctcctgacctatttctgggctccaggctagaggacgaggctagtaattttatcgcttaccctnaattactacaggcagccagtcctaccccttatgttaaccttacgggaacttcggggaccgtaacgggtccttaacccgttcccttacgtcaacgcccaacggccccaaccctcgttaacgtccc

SEQ ID NO: 432024 - DNA, 531 bp, Homo sapiens
  misc_feature: GZ8MTXP01BGH9S.38.38.D05.1.454.CMB.2.raw
  modified_base (268)..(268): a, c, t, g, unknown or other
  modified_base (516)..(516): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgcccccaaactcatcatttangacgtcactcatcgccctcaggggtttctactcgcttctctggctccaagtttggctacacggcctccctgacccctatttctgggctccaaggcctgagggacgaggctgtaattttatgtctctcatatacaggcagacagcaccccttatgtcttcggggaactgggtaccagtccaccgtcctacgtcacgcccaaggcccaacccaactcgttcacttctcgtcccacccttccttcaacgtnctcattcgcgcgggc

SEQ ID NO: 432025 - DNA, 545 bp, Homo sapiens
  misc_feature: GZ8MTXP01BDWJE.38.38.D05.1.454.CMB.2.raw
  modified_base (225)..(225): a, c, t, g, unknown or other
  modified_base (308)..(308): a, c, t, g, unknown or other
  modified_base (395)..(395): a, c, t, g, unknown or other
tcagtcgatcacgtcacgaccggtgctcgatttagtatctgatagttgggtttgggggggtctcaggaggcagcgatctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagtagtgactagtttggtggttataactatgtctcctggtaccaacaacacccaggcaaacgcccccaaactcatcatttangacgtcactcatcggcctcgaggggtttctacctcgcttctctcggctcctaagtttcggcaaacacggcctccctgacctatttcngggctccgaggctgaggacgaggctagtaatttattgcttctctatatacgaggcagcacgtcctaccccttatcgtcttcggaacgttcgggacctaaggtccaccggttccttacgtcacgcccaacggcccaaccctcttcgtaacc

SEQ ID NO: 432026 - DNA, 537 bp, Homo sapiens
  misc_feature: GZ8MTXP01AP4TH.38.38.D05.1.454.CMB.2.raw
  modified_base (266)..(266): a, c, t, g, unknown or other
  modified_base (463)..(463): a, c, t, g, unknown or other
  modified_base (511)..(511): a, c, t, g, unknown or other
  modified_base (518)..(518): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaatcatcattangacgtcactcatcggccctcaggggtttctactcgcttctctggctccaagtttggcacacggcctccctgacccccatttctgggcctccgaagggctgaggacgaggctgtaattttatgctctcatatacaggcagcacgcaccccttatgttcttcggggaactggggaccaagggtccaccgtctacgtacncgtcccaaggcccaaccccaatcgttcacttctcgtccccaccttccncaacgtnaatcgacttgaacgcgggc

SEQ ID NO: 432027 - DNA, 583 bp, Homo sapiens
  misc_feature: GZ8MTXP01BVSO2.38.38.D05.1.454.CMB.2.raw
  modified_base (268)..(268): a, c, t, g, unknown or other
  modified_base (392)..(392): a, c, t, g, unknown or other
  modified_base (557)..(557): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtgttataactatgtctcctaggtaccaacaacaccaggacaaacgccccaaatcatcattangacgtcactcatcggccctcgtagggtttctactcgcttctctgctctagtttgcaacaccgcctcctgtacccctattcgtgggctccgaagctggacggacgaggcttagtaatttacgtcncctctacaatactacgaggccagcacgcctacccttatcgttaccgttacggggaacgttcgggaacctaacggtcctacccgttcctacggtaccacgtaccccaacggccccaacccgtctcgttcaccttcgtacccttccccacccgttcttacgaacgtnaactcgacttggaacgttcgggtaac

SEQ ID NO: 432028 - DNA, 586 bp, Homo sapiens
  misc_feature: GZ8MTXP01EDXF9.38.38.D05.1.454.CMB.2.raw
  modified_base (224)..(224): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcatcaccatctcctgcactggaancagtagtgaactatttggtacttataaccatgtctcctggtaccaacatcacccagacaacggcccccaaactcataatttatgacgtcagttagtcggccctcgtaggggtttctgtactccggtcttctcacggtcctaccgaagttctcgggaccaaccgaccgggtccctccctcgaccctatcctcgtcgggctccgtaggttgacggacgagctgtacttattagttgccgtcctcactagtgaagtcgtagggtagggttttcggacgggagggaactaaaggttcggaccgttcgtaggtcacggcccgaaggtcctaccgccccgtcggtccaccgttcgttcgtttcccccg

SEQ ID NO: 432029 - DNA, 599 bp, Homo sapiens
  misc_feature: GZ8MTXP01BWB0M.38.38.D05.1.454.CMB.2.raw
  modified_base (270)..(270): a, c, t, g, unknown or other
  modified_base (541)..(541): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctaggtaccaacaacacccaggaccaaacgccccaaactcatcattangacgtcactcatcggccctcagggtttctactcgcttctctggctcctaagtttggaccaacaccggtccctccctcgacccctatttcgtcgggtcctccgaagctggaggacgaggctagtaattttatgctctacatatacaggcagcagcctacccttagtcgttcgttacggggaacgtgggaaccaacggtccacccgtcctacgtccacgtccccgaacggccccaacccaactcgttcctaaccttccgttccggttcccccnccccttcccgttaccgtaacgtcgaacttccggaacttcgggaaccggcgggtaaccg

SEQ ID NO: 432030 - DNA, 544 bp, Homo sapiens
  misc_feature: GZ8MTXP01B9YI2.38.38.D05.1.454.CMB.2.raw
  modified_base (226)..(226): a, c, t, g, unknown or other
  modified_base (327)..(327): a, c, t, g, unknown or other
  modified_base (385)..(385): a, c, t, g, unknown or other
  modified_base (425)..(425): a, c, t, g, unknown or other
tcagtcgatcacgtcacgaccggtgctcgatttagtatctgatagttgggtttggggggggtctcaggaggcagcgatctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagtagtgactatttggtggttataactatgtctcctggtaccaacaacaccaggacaaacgccccaaactcatcatttatgacgtcactcatcggccctnacggggtttctacctcgcttctctgctccaagttgcacacgcctcctcgaccatttcngggctcgaggctgaggacgaggctgaatttatcgtctctnatatacagcagcagtcaccccttatcgtcgttacggaacgttcgggacctaaagggtccacccggttccttaccgttcaaccgcccgaacggcccaaaccccgtaaccttcgtaacccc

SEQ ID NO: 432031 - DNA, 537 bp, Homo sapiens
  misc_feature: GZ8MTXP01AGBE0.38.38.D05.1.454.CMB.2.raw
  modified_base (268)..(268): a, c, t, g, unknown or other
  modified_base (344)..(344): a, c, t, g, unknown or other
  modified_base (473)..(473): a, c, t, g, unknown or other
  modified_base (498)..(498): a, c, t, g, unknown or other
  modified_base (506)..(506): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgccccaaactcatcatttangacgtcactcatcggcctcgtagggtttctactcgcttctctgctcagtttgcacacgcctcctgaccctatttcngggctcgaagctgaggacgaggtctagtaattttatcgctctcattatacgaggcagcagcctaccttatcgtcttcggggactgggaccaggtccaccgtcctacgtcacgcccaacggcccaacccnctcgttccacttcgttccgtccccncccttccncgaactgaactcgacgttgaacggcgggtcg

SEQ ID NO: 432032 - DNA, 568 bp, Homo sapiens
  misc_feature: GZ8MTXP01A5NQ3.38.38.D05.1.454.CMB.2.raw
  modified_base (557)..(557): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagtagtgactagtttggtggttataactatgtctcctggtaccaacaacacccaaggccaaacgcccccaaactcatctatttatgacgtcactcactcggccctcgaggggtttctacctcgtcttctctggctctaagtttcggacaacgaccggcctcctcgaccctatttcgtgggctccgaggctggagggtacgagggtcttagtaattttagtgccgttcctactataacgtacaaggcaagcacgtcctaccccttatcgtaacttcggaactcgggacgaacgtcacccgttcttacgtcacgaacccacggacccaacccncgttcgtaacc

SEQ ID NO: 432033 - DNA, 241 bp, Homo sapiens
  misc_feature: GZ8MTXP01AL33C.38.38.D05.1.454.CMB.2.raw
  modified_base (240)..(241): a, c, t, g, unknown or other
tcagtcgatcacgtcacgaccggtgctcgatttagtatctgatagttgggtttggtggtctccactcccgccttgacgaggctgaattttattgctcctcatatacaggcagcagcaccccttatgtcttcggaactgggaccaaggtcaccgtcctacgtcagcccaaggccaaccccatgtcactctgttcccgccctcctcacgtgatcgactgagcgggctggcaaggcgcatagnn

SEQ ID NO: 432034 - DNA, 731 bp, Homo sapiens
  misc_feature: GZ8MTXP01AROXB.38.38.D05.1.454.CMB.2.raw
  modified_base (225)..(225): a, c, t, g, unknown or other
  modified_base (307)..(307): a, c, t, g, unknown or other
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaancagtagtgactagttggtaggttataactatgtctctgtaccaacaacaccgagacaaacgaccccaaactcactcatttangacgtcactcacgtccggcctcgtacggggtttctacctcgtcttctcgtcggtccttaccgtaacgtttcggacctaaaccgacccgggtccctacccctcgtaacccttacgttttcgtcgggtccttaccgaacgggtcgtacgggaacgggtacggacgggttaccttacggttaaattttttacgttcggtacctttacccgttactaagttaacgttaaccgacgggtcaacggacctacggtaccccttaaccccgttttaacgtccggtttaacccgtttaacggggttaaaccgttaccgggggttaaacccgtaaacgggttaccccgttaccccggttcccttaaccggttccgaaacccggtaaccccgtaaacccgggaccccaaacccccggtaacgttcgttaaccccg

SEQ ID NO: 432035 - DNA, 510 bp, Homo sapiens
  misc_feature: GZ8MTXP01EBFTG.38.38.D05.1.454.CMB.2.raw
  modified_base (225)..(225): a, c, t, g, unknown or other
  modified_base (303)..(303): a, c, t, g, unknown or other
  modified_base (322)..(322): a, c, t, g, unknown or other
  modified_base (383)..(383): a, c, t, g, unknown or other
  modified_base (420)..(420): a, c, t, g, unknown or other
  modified_base (441)..(441): a, c, t, g, unknown or other
  modified_base (446)..(446): a, c, t, g, unknown or other
  modified_base (449)..(450): a, c, t, g, unknown or other
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcatcaccatctcctgcactggaancagtagtgacattggtggttataactatgtctctggtaccaacaaacacccaggcaaagccccaaaatcatcatttangactcactcatcggccctnaggggtttctactcgcttctctgacatccaaagtctggacaacacggcctccctgacatcnctgggctccgagctgagacgagactaaattagtttcngtcagttcatatacaaaccanacacnctnntcttagtcggacggaacggacagcttacgaacctactaagcacgaccgtaacgccgtccg

SEQ ID NO: 432036 - DNA, 543 bp, Homo sapiens
  misc_feature: GZ8MTXP01DYXXM.38.38.D05.1.454.CMB.2.raw
  modified_base (270)..(270): a, c, t, g, unknown or other
  modified_base (489)..(489): a, c, t, g, unknown or other
  modified_base (523)..(523): a, c, t, g, unknown or other
  modified_base (540)..(540): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaaacaacacccaggccaaacgcccccaaatcatcatttangacgtcactcatcggccctcaggggtttctactcgcttctctggctccaagtttggcaacacggcctccctgacccctatttctgggctccgaaggcgtggggacagggctgtaattttatgctctcatatacaggcagcagccaccccttatcgtcttcggaacgttcgggaaccaaaggtccaccgtcctacgtcaacgcccaacggacccaacccnctgtccactcttcgtccccaccttccttcacgtnatcgactgacgtcggcncgg

SEQ ID NO: 432037 - DNA, 682 bp, Homo sapiens
  misc_feature: GZ8MTXP01AJEFN.38.38.D05.1.454.CMB.2.raw
  modified_base (225)..(225): a, c, t, g, unknown or other
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcatcaccatctcctgccactggaaancagtagtgactagttggtggttataactatgtctcctggtaccaaacaacacccaggcaaacgcccccaaactcactcatttatgacgtcactcactccggccctcgtacggggtttctaccctcgcttctctggctcaagtttgacaacaccggcctcctcgtacctactttcgtgggtcctaccgtaggcgtaggagggaaccggagggtaccgttaggtttaaattttacgttacggtaccgttcctacgtaaacttaacgttaccgaaggggtacaaccggaccgtaaccggtaccccgttaacccctttaaacgttcggttaacccgttaccggggttaaaccgttaccggggaaacccgtaacggggttacccaccccggttacccttaccgttaacccgaccgaaccccgaaccggacccccgttaaaacccctccttcggttaaccccg

SEQ ID NO: 432038 - DNA, 575 bp, Homo sapiens
  misc_feature: GZ8MTXP01ADRFQ.38.38.D05.1.454.CMB.2.raw
  modified_base (234)..(234): a, c, t, g, unknown or other
  modified_base (268)..(268): a, c, t, g, unknown or other
  modified_base (354)..(354): a, c, t, g, unknown or other
  modified_base (538)..(538): a, c, t, g, unknown or other
  modified_base (549)..(549): a, c, t, g, unknown or other
  modified_base (563)..(563): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaanaacaccaggcaaacgccccaaactcatcatttangacgtcactcatcggccctcgagggtttctactcgtcttctctggctccaagtttggcaacacggcctccctgacccctatttcgngggcctccgaagggctggaggacgaggtctagtaattttatgctctcatatacaggcagcacgcctaccccttatcgtcgttacggggaacgtcggggaaccaacggtccaacccgttccgtaaccgtccacgaccccaacggccccaaccccgaacttcgttctaccttcgtccggttccccncccttccttcncgtgaactcgtacngaacgcgggtcg

SEQ ID NO: 432039 - DNA, 600 bp, Homo sapiens
  misc_feature: GZ8MTXP01DA237.38.38.D05.1.454.CMB.2.raw
  modified_base (263)..(264): a, c, t, g, unknown or other
  modified_base (571)..(571): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctgtaccaacaacaccaggcaaacgccccaaatcatcattannacgtcactcatccggccctgagggtttctactcgcttctctggctccagtttcggcaacacgcctcctgacccctattcgtgggctccgaaggctggaggacgaggctagtaattttatcgaccttctactatatacaggacaagcacgcctaccccttaatcgttacgttacggggaacgtcggggaacctaacgggtccaacccggttcctaacggtccaaccgtaccccaacggaccccaaacccaacttcgttaccctaaccttccgttccgtttcccccacccgttccttcctaacggttanaacttccgacgttcgaacggcgggtaacg

SEQ ID NO: 432040 - DNA, 574 bp, Homo sapiens
  misc_feature: GZ8MTXP01E0VVP.38.38.D05.1.454.CMB.2.raw
  modified_base (269)..(269): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgcccccaaactcatcatttangacgtcactcactccggccctcgtaggggtttctactcgcttctctgctcaagtttggcaacaccggcctccctgacccctatttctgggctccgaaggctggaggacgagggctagtaattttatcgtctcctcatactacaggcagcagcctaccctatcgtcgtacggggaacgtgggaccaacggtccaccgtcctacgtcacgacccaacggacccaacccaactcgttccaccttcttccgtccccaccccgttccttccaacgttcgaacttccggacttaggtaaccggcgggtccg

SEQ ID NO: 432041 - DNA, 567 bp, Homo sapiens
  misc_feature: GZ8MTXP01BT1IU.38.38.D05.1.454.CMB.2.raw
  modified_base (270)..(270): a, c, t, g, unknown or other
  modified_base (402)..(402): a, c, t, g, unknown or other
  modified_base (540)..(540): a, c, t, g, unknown or other
  modified_base (542)..(542): a, c, t, g, unknown or other
  modified_base (546)..(546): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtccgatcaccatctcctgcactggaagcagtagtgacagttggtagttataactatgtctcctaggtaccaacaacaccaggcaaacgccccaaatcatctattangactcactcatccggccctcgtagggtttctactcgtcttctctggtctctaagtttcgacaacaccgcctcctcgtaccctattcgtcggctccgaagtctgacggacgaggctagtaatttgtctctctntatatacgagctacgcacgcctacccttatcgttaccgtacggggaacgttgggaacctacggtccacccgtcgtacgtacacgtacccaacgtaccccaaccgtaactcgttcctacttcctcgtccccaccttccncnctcnctcgacttcgaacgttcggcg

SEQ ID NO: 432042 - DNA, 663 bp, Homo sapiens
  misc_feature: GZ8MTXP01EGK5Q.38.38.D05.1.454.CMB.2.raw
  modified_base (270)..(270): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacagtcgatcaccatctcctgcactggaagcagtagtgactagttggtagttaataactatgtctcctagtaaccaacaacacccagacaaacgccccaaatcatcattangactcactcatccgcctcgagggtttctactcgtcttctctggctacctaagtttcggactaacaccggcctcctgacccctatttcgtcgggtactcccgaaagggtcgtggagggaaccgagggtcttaggttaattttattcgtacctccctataatactaacgaggacaggccaactcctaaccccttagtacgttaccgtcggggtaaacgtacgggaaccgtaaacgggttaccacccgtaccgttaccgacgaaccgtaaccccgaaaccggacccaaaccccctaattccgttacaacccctttctccccggtttccccgttccccttcccttacccgaacggtacgtaacttacgggaaccttgggaaccggttcgggtaaccg

SEQ ID NO: 432043 - DNA, 631 bp, Homo sapiens
  misc_feature: GZ8MTXP01AWIIE.38.38.D05.1.454.CMB.2.raw
  modified_base (270)..(270): a, c, t, g, unknown or other
  modified_base (409)..(409): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactattggtagttataactatgtctcctagtaccaacaacaccaggacaaacgccccaaactcatctattangacgtcactcactcggcctcgtagggtttctactcgtcttctctggtctccgtaagtttcgacaacgacggcctcctgacccctattcgtggcctcgaagctggaggacgaggtctagtaattttactcgtcttcctanatactacgaggacagcacgtcctacccctttagtcgttacgttacgggggaacgtcggggaaaccgtaacggttccaacccgttcctaacggtaccaccggaccccgaaacggtccccaaaccccgtctcggttacctaccttccgttcccgttaccccttacccttccgttaccgtaacgtcgtaacgtccggtacgttacggaacggttccgggtaaccg

SEQ ID NO: 432044 - DNA, 806 bp, Homo sapiens
  misc_feature: GZ8MTXP01AHUKQ.38.38.D05.1.454.CMB.2.raw
  modified_base (280)..(280): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcagtagtgactagttggtagtttaataactatgtctcctaggtaaccaacaaccacccgaggaccaaacgcccccaaatcatcatttangacgtcactcatcgccctcgtagggtttctactcgtcttctctggtctaccgtaagtttcggaccaaccgaccggtcccttccctcgtaccccctatttcgtcggggcctccgaaagggcttgggacgggaaccggtagggtaccgttaggttaaatttttacgtcggtacccttccttactaattacgtaacgacgggtacacggacctaacgtaccccttaccccgtttagttccggtttaccgtttaccggggggtaaacgttcgggggtaaaccccgtaaacgggttaccccgtaaccccggtttaccgttaaacccggttacccgaaacccggtaacccccgtaaaacccgggaacccccctaaaacccccggtaacccttaccgggttacccctaacccgtttccccgtttaccccgggtttcccccccgttacccctttccccgttaccggtaacccggtttacggaaccgtttacccggaccggtttacgggaaccggggttccgggggttaacccgg

SEQ ID NO: 432045 - DNA, 577 bp, Homo sapiens
  misc_feature: GZ8MTXP01EHH6T.38.38.D05.1.454.CMB.2.raw
  modified_base (266)..(266): a, c, t, g, unknown or other
  modified_base (334)..(334): a, c, t, g, unknown or other
  modified_base (347)..(347): a, c, t, g, unknown or other
  modified_base (367)..(367): a, c, t, g, unknown or other
  modified_base (378)..(378): a, c, t, g, unknown or other
  modified_base (380)..(380): a, c, t, g, unknown or other
  modified_base (385)..(385): a, c, t, g, unknown or other
  modified_base (551)..(551): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctgtaccaacaacacccaggcaaacgccccaaatcatcatttangacgtcactcatccggccctgagggtttctactcgtcttctctggctacagtttgcaacacgcctccngaccctatttcgnggctccgaggctggagacgngctgtaatttntnctctnatatacagcagcacgccaccccgttatcgttcgttaccggggtaacgtcgggtaaccaaacgggttccaacccgttcctaaccgtcaacgtccccgaaacggccccaaacccgaacttacttcctactttccgtccgtttaccccaccccttccttctaaccggtntaacgtcgacgttcggcggcgggtcg

SEQ ID NO: 432046 - DNA, 597 bp, Homo sapiens
  misc_feature: GZ8MTXP01B1C2U.38.38.D05.1.454.CMB.2.raw
  modified_base (265)..(265): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctgtaccaacaacacccaggcaaagccccaaatcatcatttangacgtcactcatcggccctcagggtttctactcgcttctctggtctcaagtttgcaacaccggctccctgacccctatttctcgggctccgaaggctgaggacgaggctagtatttatcgctctcatatacgaggcagcacgcctaccccttatcgttacgttacggggaacgtcgggaccaaagggtccacccgttcctacgtccacgaccccgaacggtaccccaaacccctaacgttcgttccctaacgttcccgttacccgttccccgccccttcccgttcctaacggtcggtaacttccggacgttcggtaacgggcggggtaaccg

SEQ ID NO: 432047 - DNA, 566 bp, Homo sapiens
  misc_feature: GZ8MTXP01C5ON1.38.38.D05.1.454.CMB.2.raw
  modified_base (269)..(269): a, c, t, g, unknown or other
  modified_base (351)..(351): a, c, t, g, unknown or other
  modified_base (495)..(495): a, c, t, g, unknown or other
  modified_base (537)..(537): a, c, t, g, unknown or other
  modified_base (542)..(542): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactattggtgttataactatgtctcctgtaccaacaacacccaggacaaacgcccccaaactcatcattangacgtcactcatcggccctcgtagggtttctactcgcttctctgctcagtttggctacacgcctcctcgacccctatttcgnggctccgaaggctggagacgaggtctgtaattttatcgctctcatatacaggctagcacgcctacccttatcgtacgttacggggaacgtcggggaaccaagggtccacccgtccgtacgtccacgacccaacggcccaacccnctcgttcaccgttccttccgtccccttacccgttccttaccncgtcncgttcgacgttgaacggcggtccg

SEQ ID NO: 432048 - DNA, 539 bp, Homo sapiens
  misc_feature: GZ8MTXP01BNTJU.38.38.D05.1.454.CMB.2.raw
  modified_base (223)..(223): a, c, t, g, unknown or other
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacagggtcctgggcccagtctgccctgactcagcctgcctcgtgtctggtctccgtggacagtcatcacatctcctgcactggaancagtagtgactagttggtggttataactatgtctctgtaccaacaacaccagacaaacgccccaaatcatcatttatgacgtcactcatcggcctgagggtttctacctcgcttctctggctctaagtttgaccaacacggcctcctgacctatttctggctccgaggctggaggacgagggtctagtaatttattcgctctcatatacagcagacacgtcctaccccttatcgtcttacggactcgggaccgaaacgttccaccgttccttaacgtcgacgaacccgtaacggaccccaacctcgttcgtaaccc

SEQ ID NO: 432049 - DNA, 567 bp, Homo sapiens
  misc_feature: GZ8MTXP01ASU4L.38.38.D05.1.454.CMB.2.raw
  modified_base (268)..(268): a, c, t, g, unknown or other
  modified_base (524)..(524): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgccccaaactcatcatttangactcactcatcggccctcaggggtttctactcgcttctctgctccaagtttggacacacggcctccctgacccctattcgtggctccaaggctggaggacgaggctgtaattttatcgctctcatatacaggacagcacgccaccccttatcgtcttcggggaacgtcgggaccaacgggtccaccgtccgtacgtaccacggtaccccaacggaccccaaccccaactcgttcctaccttccgtccgttccccncccgttccttccaacgtcgaatccggacttggaacgcgggtcg

SEQ ID NO: 432050 - DNA, 551 bp, Homo sapiens
  misc_feature: GZ8MTXP01EHZVV.38.38.D05.1.454.CMB.2.raw
  modified_base (226)..(226): a, c, t, g, unknown or other
  modified_base (341)..(341): a, c, t, g, unknown or other
  modified_base (384)..(384): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaancagtagtgactagttggtggttaataactatgtctcctggtaccaacaaacacccaggcaaagccccaaatcatcatttatgacgtcactcatcggcctcagggtttctactcgnttctctggctccaagtttgcaacacgcctcctgaccatttcgnggctacgagctaggagacgagcgtagtaatttattgtcgtctactatatacagacgacgacacgtacctaccttactgtcgtacgttaacgtacgacgaacgtaacgttacgttaccgttaccgtaacgtacgaacgaccgaaccgaccctaacccgaaccgtaacg

SEQ ID NO: 432051 - DNA, 611 bp, Homo sapiens
  misc_feature: GZ8MTXP01CY15Y.38.38.D05.1.454.CMB.2.raw
tcagtcgatcacgtcacgaccggtgctcgatttagtatctgatagttggggtttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccagcagtgactattggtctattataactctgtctcgtagtaaccaaacaaccaccaggccaaacgacccccaaatctattattatgaggtccggaatccgcctacgagtaactttcctaatcgtcttctcgtcgcctccgaagtctagggaccaaccgaccgggccctcccgtagaccctatccgtctacggtacctaccgaggccgttagggacgggaacgagggtacctaggtaactttaccgtacgtagacgtattacaatataacgaactcctacttaccttccttcttcttggtttacgttcggggtacggaacggggttaccgttggggttacctaaccggtacgtaacgtcgaccgaccgtaacggttccgtccccgg

SEQ ID NO: 432052 - DNA, 646 bp, Homo sapiens
  misc_feature: GZ8MTXP01CT3ZY.38.38.D05.1.454.CMB.2.raw
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcatcaccatctcctgcactggaaccagcagtgactattggtcattatactctgtctcgtgtaccaacacaccagccaacgccccaatctattattagtgacggttaccggaactccggaccctacgtaggtaacttttaccctaatcgtctttctcgtcgggtcctccgaaacgtcgtacgggacaaccgccggtccctcccctagaccctatcctcgtacggacctaccgagggtctaggacggaccgaggcttaggtaactttacgtaccgtggacctagttacaacttaactaacaagtcctaaccttaccttccttaactttcttaggttaaccggttcgggaaccgggtacggggttacccggttaggggttaccggtaaccccgttaccgtaaacggttcccgaaccgggaccccgtaacggggttcccttcccccggg

SEQ ID NO: 432053 - DNA, 739 bp, Homo sapiens
  misc_feature: GZ8MTXP01C8HFI.38.38.D05.1.454.CMB.2.raw
  modified_base (227)..(227): a, c, t, g, unknown or other
  modified_base (234)..(234): a, c, t, g, unknown or other
  modified_base (312)..(312): a, c, t, g, unknown or other
tcagtcgatcacgtcacgaccggtgctcgatttagtatctgatagttggggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagtagngactagtttggtgttataactatgtctcctagtaaccaacaacaccgaggaccaaacgaccccaaactcatcatttangacgtcactcacgtccgcccttcgtacgggtttcctacccgtcgtctttctcgtcggtaccttaccgtaagtttcgaccaaaccgaccggtcccctcccgtacgacccttacgtttcgtacgggtcctaccggtaggtacgttagggacggggtaacggtacgggtaccgtttaaaggttaacttttttaacgttccggttaccgtttacccgttacgtaaacttaaccgttaacgacgggaaccacgtaccgtaaccgtacccttaaccccgtttaagttcccggtttaaccgttaaccgggttaaaccggttcggggaaacccgtaaacgggttcccttaaacccggtttcccgttaaaccggtaacccgaacccggaaccccgtaaaccggacccccaaccccgttaaccgttccgttaacccg

SEQ ID NO: 432054 - DNA, 621 bp, Homo sapiens
  misc_feature: GZ8MTXP01DTS36.38.38.D05.1.454.CMB.2.raw
  modified_base (231)..(231): a, c, t, g, unknown or other
  modified_base (267)..(267): a, c, t, g, unknown or other
  modified_base (371)..(371): a, c, t, g, unknown or other
  modified_base (396)..(396): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataatttgtctctgtaccaanagcaccgggcaatcgacccccaaaatcatgatttangaggtcactcactcggccctcgtagggtttctaatcgtcttctctgacactccaagtctaggacaacgaccggcctccctacgaccatctcgtcgggcctccgnggctggacggacgtaggcttaattnttctgactagtcataataaccaacagacaactactctagtcttagggttccgggagggaacggtacccgaaagtctaccggaacccgttaaccgtaacgtccgaacggaccccgaaagggtccctacccggttccccccgttcgggttacctacccgttcccgttccgttccccccgttccctcctacgtaaccgttcgaacgttccgaacggttggaacccggg

SEQ ID NO: 432055 - DNA, 579 bp, Homo sapiens
  misc_feature: GZ8MTXP01CI777.38.38.D05.1.454.CMB.2.raw
  modified_base (223)..(223): a, c, t, g, unknown or other
  modified_base (307)..(307): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcatcaccatctcctgcactggaancagtagtgactagttggtggttataactatgtctcctggtaccaacaacacccaggaccaaacgcccccaaactcatcatttangacgtcactcatcgcctcgtaggggtttctacctcgtcttctctgctctaagttgacacacggcctcctgacctatttcgtggctcccgaggcctaggacggacgaggtcttacgttaaattttattcgaccttctactattaacgtacagggcaggccacgtcctaccccttatcggttccgttcggaaacgtcggggaaacctaaacgggtccttacccggttccttaccgtccacgtcccgaacggcccaaacccctcgttcgtaaccc

SEQ ID NO: 432056 - DNA, 572 bp, Homo sapiens
  misc_feature: GZ8MTXP01B3QC6.38.38.D05.1.454.CMB.2.raw
  modified_base (268)..(268): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttangactcactcatcgccctcagggtttctactcgcttctctggctcaagtttggcaacacggcctccctgacccctatttctgggcctcaaggctgaggacgaggctgtaattttatcgctcctcatatacaggcagcagccaccccttatcgtccgttacggggaacgtcggggaaccaaagggtccctaccggtcctacgtcacgacccaacggcccaaccccaactcgttaccacttccgtccgttccccgccccttccttcgaaccgtgaacttccggacttcggaacggttcggggaaccg

SEQ ID NO: 432057 - DNA, 444 bp, Homo sapiens
  misc_feature: GZ8MTXP01D38UK.38.38.D05.1.454.CMB.2.raw
  modified_base (241)..(241): a, c, t, g, unknown or other
  modified_base (286)..(286): a, c, t, g, unknown or other
  modified_base (435)..(444): a, c, t, g, unknown or other
tcagtcgatcacgtcacgaccggtgctcgatttagtatctgatagttgggtttgggggctttgcctgggtgttgttggtaccagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttcngggctccaggctgaggacgaggctgtaattttatgctcctcatanacaggcagcagccaccccttatgtcttcggaactgggaccaaggtcaccgtctacgtcacgcccaagcccaaaccccactcgtccactcctcgttcccccgcccctctcacgtgactcgactggacgcgggctggcaagggcacatagnnnnnnnnnn

SEQ ID NO: 432058 - DNA, 530 bp, Homo sapiens
  misc_feature: GZ8MTXP01AOPDI.38.38.D05.1.454.CMB.2.raw
  modified_base (267)..(267): a, c, t, g, unknown or other
  modified_base (343)..(343): a, c, t, g, unknown or other
  modified_base (508)..(508): a, c, t, g, unknown or other
  modified_base (512)..(512): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaatcatcatttangacgtcactcatcggccctcagggtttcactcgcttctctggctccaagtttggcacacgctcctgacccatttcnggctcaagctgaggacgagctgaattttatgctctcatatacaggcagcagccacccttatcgtcttacggggactcggggaccaacgggtccaccgtcctacgtccacgccccaaggcccaaaccccgaactcgttcaccttcctcgttcccgcccttccttcncgtnaactcgacttgcgcgggc

SEQ ID NO: 432059 - DNA, 567 bp, Homo sapiens
  misc_feature: GZ8MTXP01CRDK6.38.38.D05.1.454.CMB.2.raw
  modified_base (227)..(227): a, c, t, g, unknown or other
  modified_base (258)..(258): a, c, t, g, unknown or other
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacagggtcctgggcccagtctgccctggctcagcctgcctccgtgtctggtctcctggacagtcgatcaccatctcctgcactggaaccngcagtgagttggtgtataattgctctgacangcaccggcaactcgaccccaaatcatgatttatgaggtcactcacgtccggcccttcgtaggggtttctaagtcccgtcttctctcgactaactccaagtctacgggacctaaccgccggccctccctcgaccctatcgtcgtcggcctcgagggtcgtaggaggacgtacggacttaagtttactttcgtcggtacttagttacaattaactaccaacctagaacctaactacgtctcgtcttagttcgggacggacgggaaccagccgttgccgtaactacgcgacgaccgacgtccgccgtccccg

SEQ ID NO: 432060 - DNA, 613 bp, Homo sapiens
  misc_feature: GZ8MTXP01B85LX.38.38.D05.1.454.CMB.2.raw
  modified_base (269)..(269): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgcccccaaatcatcatttangacgtcactcatccggccctgagggtttctactcgcttctctggctcctaagtttggcaacacggcctccctgaccccctatttctgggcctccgaagggctggaaggacgaggtctgtaattttatcgtcttcctctatatacaggcagctacgccaccccttatcgttccttacgggggaacgttgggggaacccaaagggttccaacccggttcctacgtaccacgtaccccaaacggacccctaaccccaacgtcgttcctaaccttccttaccgttccccttaccccgttcccttacaaccggttgaacttccggacgttacgggaacggttcgggtcg

SEQ ID NO: 432061 - DNA, 814 bp, Homo sapiens
  misc_feature: GZ8MTXP01A4466.38.38.D05.1.454.CMB.2.raw
  modified_base (230)..(230): a, c, t, g, unknown or other
  modified_base (313)..(313): a, c, t, g, unknown or other
tcagtcgatcacgtcacgaccggtgctcgatttagtatctgatagttgggtttggggggggtcgtcaggaggcagcgctctcaggacatctccaccatggcctgggctctgctgctcctcaccctcctcactcagggcacgagggtcctgggcccagtctgccctgactcagcctgcctcgtgtctgggtctcctggacagtcgatcaccatcctcctgcacgtggaaancagtagtgactagtttggtggttataactatgtctcctggtaaccaacaacaccaggacaaacgaccccaaatcatcatttangactcactcacgtccggccctcgtaggggtttcctacctcgtcttctacgtcggtaccttaccgtaaggtttcgggacctaaaccgtacccgggtcccccttacccctacggtaaccccttagtttttcccggtacgggggtccccttaccggtaacggggtcgttacgggggaaccggggtaacgggtacgggtacccgtttaagggttaaactttttttaacgttcggtccccgtttaccgttacccgttaaattaaccgttaaccgagggggtaaccaacggttaccgaacccggttaccccttaaccccctttaaggtttcggtttaacccggttttaacccggggaaacccgggttccgggggttaaacccccgtaaacgggggtttcccccaacccccgggttttacccgttaacccgggttaacccgaaccccggtaacccccggtaaacccgggacccccttaaaaccccccgtccgttcggtttaacccccc

SEQ ID NO: 432062 - DNA, 621 bp, Homo sapiens
  misc_feature: GZ8MTXP01BMJ71.38.38.D05.1.454.CMB.2.raw
  modified_base (267)..(267): a, c, t, g, unknown or other
  modified_base (382)..(382): a, c, t, g, unknown or other
  modified_base (524)..(524): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacacacccaggcaaacgccccaaactcatcatttangacgtcactcatcggccctcagggtttcactcgcttctctgctccagtttggcacacggcctccctgaccccatttctgggctccgaaggctgagggacgaggctagtaattttntacgctctcatatacaggcagtccagcctaccccttatcgttaccgttcgggggaaacttcgggggaaccctaaacggggttcccaaccccggttcccctaacggttaccaacggtacccccgaaacggccccaaaccccgngttcggttaccaaccgttcctcccggtttaccccacccctttccgttacctaaccggttcgaacgttcccgaacgttcggaacggttccggggtccg

SEQ ID NO: 432063 - DNA, 624 bp, Homo sapiens
  misc_feature: GZ8MTXP01A2OB5.38.38.D05.1.454.CMB.2.raw
  modified_base (207)..(207): a, c, t, g, unknown or other
  modified_base (212)..(212): a, c, t, g, unknown or other
  modified_base (215)..(215): a, c, t, g, unknown or other
  modified_base (220)..(220): a, c, t, g, unknown or other
  modified_base (226)..(227): a, c, t, g, unknown or other
  modified_base (246)..(246): a, c, t, g, unknown or other
  modified_base (252)..(252): a, c, t, g, unknown or other
  modified_base (275)..(275): a, c, t, g, unknown or other
  modified_base (281)..(281): a, c, t, g, unknown or other
  modified_base (285)..(285): a, c, t, g, unknown or other
  modified_base (291)..(291): a, c, t, g, unknown or other
  modified_base (360)..(360): a, c, t, g, unknown or other
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcacntctcngcngagancagtannatgttggtagttataactntcgtcnctagaacaacacaccagacaacncccaancatntattanagactcactacacgtccgcctagtcggttcctactctctcgtcgtgtaccttacgtgttcacgtaaccnccgtcctcctagtacctagtttcgcgtctaccgagcgttaggacgggtacgtaggtaccttagttaaactttttatccggttcttacccttataacgttacgtaacgccggacacggacctacgtaaccccttaccgtttacgttcggtaaccgtttacggaacggttcccggaaaccgttaacgtaccccgttaccgttccgttaccgccgaaacccggaacccgtaacccgaaccccttaacccctgttaaccgttaacccc

SEQ ID NO: 432064 - DNA, 655 bp, Homo sapiens
  misc_feature: GZ8MTXP01EKLZ3.38.38.D05.1.454.CMB.2.raw
  modified_base (190)..(190): a, c, t, g, unknown or other
  modified_base (279)..(279): a, c, t, g, unknown or other
  modified_base (419)..(419): a, c, t, g, unknown or other
  modified_base (423)..(423): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgactatttgggtggttaataacttatgtctcctaggtacccaacaaccacccaggaccaaacgcccccaaatcatcatttangacgtcactcatccggccctcgtagggtttctactcgtcttctctggctactagtttggcaacgacggtcctcccgtcgacccctatttcgtcgggctcccgaaggctggaggacgaggctagtaattttactgtctctnatanacgagcagcacgcctacccttagttcgtacttcggggaacgttcggggaacctaacggtccaaccgttccgtaacgttccaacgaccccgtaaacggccccaaaaccccgtctccggttaccctaacccgttccgttacccgtttccccccggcccccgtttaccttcccgtaaacccggttcggtaacccgttccggtaaccgttacgggcgggttcccggggtaacccgg

SEQ ID NO: 432065 - DNA, 672 bp, Homo sapiens
  misc_feature: GZ8MTXP01DSWB9.38.38.D05.1.454.CMB.2.raw
  modified_base (272)..(272): a, c, t, g, unknown or other
  modified_base (333)..(333): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtcctgccctgactcagcctgcctccgtgtctgggtctcctggacagtcgatcaccatctcctgcactggaagcagtagtgacagttggtagttataactatgtctcctgtaaccaacaacaccaggaccaaacgccccaaatcatacatttangactcactcactccggcctgtaggtttcactcgcttctctgctaccgaagtttcgacaacnccgcctcctcgaccctattcgcggcctccgaaaggtcgtggaacgggaaccgagggtacttaagttaattttcgtctccttacctataactaatacgacggacacgtcaacgtcctacccttagtcgttacccgttacggggaaacgttacggggaaaccctaacgggttaccctaacccggttccctaaccgtaccgaaccgtaaccccgaaccggtaacccccaaacccgtaacttccgttcctaaacccttcccgttcccgttacccccggttcccttaccgttacgtaaccgttcgtaacgttcccgggtaattcggggtaacgggcgggtccgg

SEQ ID NO: 432066 - DNA, 532 bp, Homo sapiens
  misc_feature: GZ8MTXP01CM4F4.38.38.D05.1.454.CMB.2.raw
  modified_base (270)..(270): a, c, t, g, unknown or other
  modified_base (331)..(331): a, c, t, g, unknown or other
  modified_base (342)..(342): a, c, t, g, unknown or other
  modified_base (472)..(472): a, c, t, g, unknown or other
  modified_base (508)..(508): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctaggtaccaacaacacccaggcaaacgccccaaactcatcatttangactcactcatcggccctcgagggtttctactcgcttctctgctcagttgcacacgctccngaccctattcnggctcaaggctgagcgagctagtatttatgctctcatatacaggacagcacgctacccttagtcgtcgttacgggggaactcgggaacctacgggtccaccgtcctacgtcacgcccaacgcccaacccnctcgctaccttcctacgtccccacccgttccttacnctgaactcgacgttcgcggcgtcg

SEQ ID NO: 432067 - DNA, 703 bp, Homo sapiens
  misc_feature: GZ8MTXP01EWNQR.38.38.D05.1.454.CMB.2.raw
  modified_base (269)..(269): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacagttggtgttataactatgtctcctggtaccaacaacacccaggacaaacgccccaaatcatctattangacgtcactcactccggtccctcgtagggtttctactcgtcttctctggtcctccgtaaagtttcggacctaaccgaccggcccttccctacgtacccccttagtttcgtcggggcctacccgaagggtctcgggaacgggtacggacgggtcttaggttaaattttacgttcgtcccttacctactaactaacgtacgagggtacacgacacgtaccctaccccttatacgtaccgttacggggaacgttacggggaacctaacgggtacctacccgtacctaaccggtaccacgtaaccccgaacggtaccccaaaccccgtaactaccggttccctaaccgttcccgttcccggtttcccccttccccgttaccgttccgtaaccgtcgaacgttccgggtaacttcggggaacgggttccgggtaaccgg

SEQ ID NO: 432068 - DNA, 774 bp, Homo sapiens
  misc_feature: GZ8MTXP01ENN0I.38.38.D05.1.454.CMB.2.raw
  modified_base (247)..(247): a, c, t, g, unknown or other
  modified_base (265)..(265): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactattgggtgttataactatgtctcctgtaccaacacaccagacaacnccccaaatcatcatttangacgtcactcagtccggccctcgtacgggtttctactcgtcttctctggccttactaaggtttggaccaacgtaccggtcccctccctacgtaccccctagttttcgcggggtccttacccgaacgggtccgttgggaaacggggtacggtaacggggtcctttaagtttaaagttttttacgttcgcccctttacgtactaaataattaaccgacggtacaacgccaacgtaccttacccctttaagttccggttaccgtttaaccgggggaacgttaaccgggggtaaccctaaacggggttccctaaaccccggttcctttaaacccggtaccgaaacccggtaccccccgaaaaccgggtacccccctaaaaccccccgtcggtttaccccgttacccgttaacccctttccttacccccggtttaccccccaaccccgtttcccttacccggtaaccgttacgaaccttcccgggtaacgttcgggtaacggggccggtccggg

SEQ ID NO: 432069 - DNA, 805 bp, Homo sapiens
  misc_feature: GZ8MTXP01DNMKG.38.38.D05.1.454.CMB.2.raw
  modified_base (246)..(246): a, c, t, g, unknown or other
  modified_base (275)..(275): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttggtagttaataactatcgtctaccgtagtaaaccaaaaacnccagacaaacgccccaaatcatctattangacgtcactcactccgcctcgtagggtttctacgtcgtcttctctcggtcttaccgtaagtttcggactaaccgaccggtccctcccgtagtaacccttacgtttccggtcggggtacccttcccgaggtaccgttacgggaacggggaccgtaacggggtacctttaaggtttaaacttttttacgttcgtcccttacccttactaaattacgtaacgacgggtacacggtacctaccgtacccttaacccccgtttagtaccggttacgtttaacccgggtaaacggggttaccggggaaacccgttaacgggtaccccgtaacccggttaccccgtaaccggttaccgaacccgggaccccgtaaacccgggacccccctaaaccccggtccgttaaccggttacccgttaaccctttcccgtttccccgggtttccccccgtaccccctttacccgggttccttacccgggtttaacacgttcccggtaacgttcgggaccgggtccggggttaacgtaaccgggg

SEQ ID NO: 432070 - DNA, 570 bp, Homo sapiens
  misc_feature: GZ8MTXP01A60YA.38.38.D05.1.454.CMB.2.raw
  modified_base (273)..(273): a, c, t, g, unknown or other
  modified_base (394)..(394): a, c, t, g, unknown or other
  modified_base (541)..(541): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtaggttataacttatgtctcctaggtaccaacaacacccaggcaaacgcccccaaactcatcatttangactcactcatccggcctctaggggtttctactcgcttctctggctcgaagtttggcacacggcctcctgacccctatttctgggctcccaaggcctgaggacgaggcttagtacttttangtctctacatactacaggcagcacgcctaccccttatcgtacttacggggaacttagggacctaacggtaccaccgtacctaccgtcacgtcccaacggcccaacccgctcgttcctacttccgtccgttccccgcccttccttccncgtcaacttcgcttcgaacgcgggtaacg

SEQ ID NO: 432071 - DNA, 570 bp, Homo sapiens
  misc_feature: GZ8MTXP01DIP5K.38.38.D05.1.454.CMB.2.raw
  modified_base (270)..(270): a, c, t, g, unknown or other
  modified_base (355)..(355): a, c, t, g, unknown or other
  modified_base (376)..(376): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtagttataactatgtctctaggtaccaacaacacccaggacaaacgacccccaaatcatcattangacgtcactcatccgcctcgtacgggtttctactcgcttctctggctacgtaagtttcggacacacgcctcctgaccctatttcncgggctcgaagctggagacgnggtctagtatttgtctcttctacatatacgaggacagcacgacctaccccttatcgttacgttacggggaacgttacgggaacctaacggtccacccgtcctaaccgtacacgacccacgacccaaccctaactcgttacctacttcctcgtacccttcttccttcctcagtcgactcgactcggaaggtccgg

SEQ ID NO: 432072 - DNA, 600 bp, Homo sapiens
  misc_feature: GZ8MTXP01CHQBB.38.38.D05.1.454.CMB.2.raw
  modified_base (274)..(274): a, c, t, g, unknown or other
  modified_base (338)..(338): a, c, t, g, unknown or other
  modified_base (354)..(354): a, c, t, g, unknown or other
  modified_base (359)..(359): a, c, t, g, unknown or other
  modified_base (378)..(378): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttggtgttaataactatgtctcctagtaaccaacaaccacccaggacaaacgcccccaaatcatctattangacgtcactcactccggccctgtacgggtttctactcgtcttctctgctctaagtttcgacacncgcctcctgacccctnttcgnggctcgaagctgaggacgngtctagtattttatcgtcctctacatactacgagacacgcacgtccctacccttagtcgttaccgttacggggacgttacgggaacctaacgggtcctaccgtccctacgtaccaccgtccccaacggccccaacccctctcgttcctaccttcccgttcccgttccccacccgttccttaccgtaacgtcgaacttccgacgttacggcggcgggtaaccg

SEQ ID NO: 432073 - DNA, 687 bp, Homo sapiens
  misc_feature: GZ8MTXP01ADQYG.38.38.D05.1.454.CMB.2.raw
  modified_base (230)..(230): a, c, t, g, unknown or other
  modified_base (316)..(316): a, c, t, g, unknown or other
tcagtcgatcacgtcacgaccggtgctcgatttagtatctgatagttgggtttgggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatcaccatcctcctgcacgtaggaanctaagtagtgactagttggttggttaataactatgtctctagtaccaacacaccaggaccaaacacccccaaatcatactatttangaccgtcactcacgtccgcccttggtacggggtttcctacctcgtcttacgtctgtacctacgttaacgttcggactaaccgccggtacccttccgacgtaccctagtttcgcggcctcgaggtccgtagggacggacgaggtacttagttaaatttcgttcgaccttacctataacttaacgtacgaacggccaacggtaccgtacccgtaccttaacccctttgttacggttaacggttaccggaaacggggttacggaacccgtaaacggggttcccttaaccccgggttccttaacccgggtccaaccccgggtaaccccgtaaaacccggacccccgttaaaccccgtaacttccggtttaacccc

SEQ ID NO: 432074 - DNA, 832 bp, Homo sapiens
  misc_feature: GZ8MTXP01A0QHR.38.38.D05.1.454.CMB.2.raw
  modified_base (271)..(271): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacagtcgatcaccatctcctgcactggaagcagtagtgactagttggtgttataactatgtctcctggtaccaacaacacccaggaccaaacgccccaaactcatcatttangacgtcactcagtcggccctcgagggtttctactcgtcttctcgtcggcttccgtaagtttcggacaaccgtaccggcccttaccccgtacgaacccccttacttttccgtgggggtccttacccgaaacgggtccgttaagggaaaccggggtaccgggtaaacggggtacctttacgggttaaaactttttttacgtttacggtcccctttacccgttacgtaaactttaacgttaaccgaacggggtacctaaacgggccaaaccgggttaccccgttaacccctttaacgtttacggttacccgttttaaccggggggaaaccgtttaacgggggaaccccgtaaacggggttaccccgtaaccccggttccgttaaccgttaccgaacccggtaccccgaaacgggtcccccaaaccccgtaacgttaccggttacccttaaccttccccgtttaaccggttaccccccaaccccctttcccgtttaccccgaaccgggttccggtaaccttaacccgggtacggttccgggtaacggggcccggggttaaccggg

SEQ ID NO: 432075 - DNA, 691 bp, Homo sapiens
  misc_feature: GZ8MTXP01A00W5.38.38.D05.1.454.CMB.2.raw
  modified_base (229)..(229): a, c, t, g, unknown or other
  modified_base (255)..(255): a, c, t, g, unknown or other
  modified_base (272)..(272): a, c, t, g, unknown or other
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacgagggtcctgggcccagtctgccctggctcagcctgcctccgtgtctgggtctcctggacagtcgatcaccatctcctgcactggaaccngcagtgacgttggtagttaataaatntgtctcgtagaaccaanactcaaccaacactaccaacccgaaggaccaaaaccgtaccccaaaatctaaattaaactttagaggaacggtaccaaaccgtaaaccggcctagaggttactttacaatcgtcttctacgtcgtctactaagtctaggacctaacgccggtccctcctagacctagtcctacgtcggtacctacccgaacgtgggaacggacgtacgtacctactaacgtttattagtcgactacgtcctagtaaactttaacaacgaacgtccgtaacggtccgttaacgtcggggttttcgggggtccgggttaccggggaacggggtaacccggggttaaccccgttccggttaccgggtaacccggttgtttaaccgggcccgaaccggttaccccggtaacgggttccccgttcccccccggg

SEQ ID NO: 432076 - DNA, 626 bp, Homo sapiens
  misc_feature: GZ8MTXP01ARGXU.38.38.D05.1.454.CMB.2.raw
  modified_base (266)..(266): a, c, t, g, unknown or other
  modified_base (596)..(596): a, c, t, g, unknown or other
  modified_base (602)..(602): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcagtatgacattggtgttaataactatgtctcctggtaccaacaacaccaggacaaacgccccaatcatcattangactcactcacgtccgccctcgtagggtttctactcgtcttctcgtggtcctacgtaagtttcggaccaaccgaccggtccttcccgtacgtaacccctacgtttcgcggggtcctacccgaaggcctggacgggacggaacggtctagttaatttttactcgtccttctactaatactaacaggacacgcaacgtcccttaaccccgttagtcgttaccgttacgggggtaacgtcggggtaacctaacggtcctaccgtacctaccgtacaccggtacccaacggaccccaacccgtaactcgttcacttcctccgtcccaccttccnctcgtnaacctcgcgttacggcggcggtcg

SEQ ID NO: 432077 - DNA, 631 bp, Homo sapiens
  misc_feature: GZ8MTXP01EJPPD.38.38.D05.1.454.CMB.2.raw
  modified_base (190)..(190): a, c, t, g, unknown or other
  modified_base (269)..(269): a, c, t, g, unknown or other
  modified_base (358)..(358): a, c, t, g, unknown or other
  modified_base (363)..(363): a, c, t, g, unknown or other
  modified_base (404)..(404): a, c, t, g, unknown or other
  modified_base (441)..(441): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgactattggtagttataactatgtctcctaggtaccaacaacaccaggacaaacgccccaaatcatcattangacgtcactcatccggccctcgtagggtttctacgtcgtcttctcgtgctactagtttcggacaacgaccggcctccctcgtacccctnttcgngggcctaccgaaggctggaggacgaggtcttagtaattttnttcgtcctctactatatacgaggactaggactaaccnccttacccgttagttcgttacgtacggggtacgtacgggtaaccgtacggtcccgtaccgtccgtacgaccgaccgtacccgaaccgtaccccaaccgtcgttcgttcctaccgttccgttcccgttccccgttcccgttccgttaccgtaacgtcgtaacgtcgtacgttcggtccggttcgggtaacg

SEQ ID NO: 432078 - DNA, 692 bp, Homo sapiens
  misc_feature: GZ8MTXP01BL9UE.38.38.D05.1.454.CMB.2.raw
  modified_base (190)..(190): a, c, t, g, unknown or other
  modified_base (299)..(299): a, c, t, g, unknown or other
  modified_base (599)..(599): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgactagtttgggtaggtttaataaacttattcgttccttaccgtaggtaaacccaaacaaaccacccgaaggaccaaaccgacccccaaatcatctatttangacgtcactcatccggccctgtagggtttctactcgtcttctctcggtcttaccgtaagtttcggaccaaaccgtccggccctcctacgtaccccttacgtttcgtcgggacctccgaacgggtctgggaacggtacggtaggtactttagttaaacttttgttcgcccttctactaatacgtacgaggacacgcacgtaccctacccttatcggttaccgttacggggaacgttcggggaacctaacgggtccacccgttccgtacgtaccgaccgtacccgaacgaccctaaccccgnttccgttacctaccttccgttaccccttccccttaaccccttccttacgtaaccggtcaacgttccggtacgttacgggtcggccgggtaacg

SEQ ID NO: 432079 - DNA, 782 bp, Homo sapiens
  misc_feature: GZ8MTXP01AKP6K.38.38.D05.1.454.CMB.2.raw
  modified_base (188)..(188): a, c, t, g, unknown or other
  modified_base (271)..(271): a, c, t, g, unknown or other
  modified_base (290)..(290): a, c, t, g, unknown or other
  modified_base (367)..(367): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacagtcatcaccatctcctgcactggaancagtagtgacattggtgttaataactatgtctcctaggtaacccaacaacacccaggaccaaacgcccccaaatcatcattangacgtcactcatcggcctnaggggtttctactcgcttctctggctaccaaggtttcggcctaaacacggtccctccctcgtaacccctattttcgnggggctcccgaagggcctggacggggtacgagggcttaggtaaatttttagtccgtaccttccctacctaatacgttaacacggggtaccaacgtaccgaaccggtaccctaaccccccctttaaagttccgggtttacctttacccggggggaaaacggttccgggggtaaaccccgaaaccgggggttttaccccaaaccccggggtttacccctaaacccgggtttccaaaccccgggtaacccccgaaaaccgggggtaccccccaaaaccccccggtaaccttcccgggtttacccaaacccggttttccctaccccgggtttacccccccttaccccggtttcccgttacccaaccgggtttaccggaacttcccgggaacgttcgtaacggggttcccggggtcccgg

SEQ ID NO: 432080 - DNA, 602 bp, Homo sapiens
  misc_feature: GZ8MTXP01EZ1YZ.38.38.D05.1.454.CMB.2.raw
  modified_base (281)..(281): a, c, t, g, unknown or other
  modified_base (344)..(344): a, c, t, g, unknown or other
  modified_base (353)..(353): a, c, t, g, unknown or other
  modified_base (360)..(360): a, c, t, g, unknown or other
  modified_base (393)..(393): a, c, t, g, unknown or other
  modified_base (410)..(410): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctcgtgtctgggtctcctggacagtcgatcaccatcctcctgcacgtggaagcagtagtgactagtttggtagttaataacttatgtcctcctagtaaccaacaacacccaggaccaaaccgcccccaaatcatctatttangacgtcactcacgtccggccctgtagggtttctactcgtcttctctgctcgtagttcgacacnccgcctccngaccctnttcgcggctcgagctgagcgagctagttatttntctctctacatatacgngacagcacgtacctacccttgtacgttcgtacggggaacgtacgggaacctacggtccacccgtcctaccgtccgaccgtcccgaacgccccaacccgtaacttcgttcctacccgtttccgttcccggtcccccgttaccccttccgttcgtaaccgtcgtaactcgtacgttggaaccggttccgggtcg

SEQ ID NO: 432081 - DNA, 516 bp, Homo sapiens
  misc_feature: GZ8MTXP01EZEUR.38.38.D05.1.454.CMB.2.raw
  modified_base (233)..(233): a, c, t, g, unknown or other
  modified_base (266)..(266): a, c, t, g, unknown or other
  modified_base (350)..(350): a, c, t, g, unknown or other
  modified_base (417)..(417): a, c, t, g, unknown or other
  modified_base (471)..(471): a, c, t, g, unknown or other
  modified_base (496)..(496): a, c, t, g, unknown or other
  modified_base (503)..(503): a, c, t, g, unknown or other
  modified_base (505)..(505): a, c, t, g, unknown or other
  modified_base (509)..(509): a, c, t, g, unknown or other
  modified_base (516)..(516): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaanaacacccaggcaaagcccccaaatcatcattangacgtcactcatcggccctcaggggtttctactcgcttctctggctccaagttttggcaacacggcctccctgaccccatttcngggctccaaagggctgaggacgagggctagaattttatgctctcatatacaggcagcagcaccctangtcttcggggaactgggaccaaggtcaccgtctacgtcagcccaagccaacccnctgcacttctcgttcccacccttcncaacgtncncacngcgcggn

SEQ ID NO: 432082 - DNA, 830 bp, Homo sapiens
  misc_feature: GZ8MTXP01ATX0W.38.38.D05.1.454.CMB.2.raw
  modified_base (190)..(190): a, c, t, g, unknown or other
  modified_base (267)..(267): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtagttataactatgtctctggtaaccaacacaccgagacaaacgccccaaatcatctattangacgtcactcatccggccctcgtagggtttctacgtccgtctttctcgttcgggtcttaccgtaacggttttacgggacctaaaccggtacccgggtcccttaccccgttaggaaccccccttagttttcgtcgggggccttcccggtaaggggtccttaagggtaacggggaccggtaaggggtcctttagggttaaactttttaacggttcgtcccttaccgttacaaacgttacgtaacctaaggggtcctaaacgggcctaaacccgggtacccttaaaccccccgtttaagttcggtttaccgttaaccggggggtaaacttaccggggggtaaacctaaaccgggggttacccctacccggttacccgttaaacccggttaccggtaaaccgtaccccccgggaaaacccggtacccctaaacccccccgtaagtcccgggttaaccctaacccgtttccgttcccgggtcccccgttccccgtttccgttacccgaaccggtttcgaacccggtttccggtaacccgggcgggtaaccgggttcccgggtaaccgg

SEQ ID NO: 432083 - DNA, 643 bp, Homo sapiens
  misc_feature: GZ8MTXP01DR7JR.38.38.D05.1.454.CMB.2.raw
  modified_base (218)..(218): a, c, t, g, unknown or other
  modified_base (247)..(247): a, c, t, g, unknown or other
  modified_base (265)..(265): a, c, t, g, unknown or other
  modified_base (365)..(365): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtaggttataactntgtctctagtacaacacaccagacaaacnccccaaactcatcattanagacgtcactcatccggccctcgtagggtttctactcgtcttctctggcttactaagttttcggacgaacaccggcccttccctacgtacccctatttcncgggtctccgaagtctggaggacgaggctagtaattttatgcttctatatatacaggacacgcacgcctacccttagtcgttacgttacggggaacgttacggggaacctaacggtacctaacccgtaccgtaccggtaccacgtaccccgaacggacccctaaaccccaacgttcgttacctaaccttccgttcccgtttcccccgccccgttcccttaccgtaaccggttacgtaaccgttaccggacgttacgggaaccggttccgggtaaccgg

SEQ ID NO: 432084 - DNA, 751 bp, Homo sapiens
  misc_feature: GZ8MTXP01B7ABD.38.38.D05.1.454.CMB.2.raw
  modified_base (192)..(192): a, c, t, g, unknown or other
  modified_base (272)..(272): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatcctcctgcacgtggaancagtagtgactattggtgttaataactatcgtctcctaggtaccaacaacacccaggacaaacgccccaatcatctattngactcactcagtccgccccgtcgtacgggtttctacgtcgtcttctcgtgtcctccgtaagtttcgaccaaccaccgtccctccctagtacccctacgttttcgtcgggccttccgaagggtcctgggacgggaccggtcgtactttaggtaactttttcgtcgtaccttccgttactaacttacgtaacgaggtaccacggtctaaccggtacccttaaaccccgtttgttaccggttacccgtttaccgggggtaaccggtacggggtaaacccgtacggtacccgaaccccgttccgtttaaccgaccgacccgtaaacccccgtaaccgggtaaccccctaaaccccgtaacccgtttacgttccccgttaacccgtttcccggttaccccgttccccccgttaccccgtttcccttacccgtaaccggtcggtaaccttccgggacgttcgggaaccgggttccggtaacccgg

SEQ ID NO: 432085 - DNA, 520 bp, Homo sapiens
  misc_feature: GZ8MTXP02GYMOC.38.38.D05.1.454.CMB.2.raw
  modified_base (470)..(470): a, c, t, g, unknown or other
tcagtcgatcacgtcacgaccggtgctcgatttagtatctgatagttgggtttgggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccccatttctgggctccaggctgaggacgaggctgaattttatgctcctcatatacagcagcagcaccccttatgtcttcggaactgggaccaaggtcaccgtctacgtcagcccaaaggccaaaccccnctacgtcactctcgttcccgccctcctcaacgtgactcgactgacgcggc

SEQ ID NO: 432086 - DNA, 523 bp, Homo sapiens
  misc_feature: GZ8MTXP02IUH4V.38.38.D05.1.454.CMB.2.raw
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggcccctcaggggtttcactcgcttctctggctccaagtttggcaacacggcctccctgaccccatttctgggctcaggctgaggacgaggctgaattttatgctctcatatacaggcagcagcacccttatgtcttcggaactgggaccaagggtcaccgtctacgtcagcccaaaggcccaaaccccactgtccactctcgttcccgccctcctcaacgtgactcgactcgacgcgggcg

SEQ ID NO: 432087 - DNA, 509 bp, Homo sapiens
  misc_feature: GZ8MTXP02FTFJK.38.38.D05.1.454.CMB.2.raw
  modified_base (206)..(206): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgtgttgacgcagccgccctcagtgtctgcggccccaggacagaaggtcaccatctcctgctctggaggcagctccaacattgganattaattttgtctcctggtaccagcagctcccaggaacacgcccccaaactcctcatttatgaccataataggcgaccctcagggattcctgaccgattctctggctccaagtctggcacgtcagccacctggcatcaccggcctccagctggggacaggccgattatactgcggaacatgggataccagactgaatgcttggatgcgtcggtggagggaccaggctgaccgtctaggtcagccaggctcgccccctggtccactctcgttcccgccctcctcacgtcactcgactgacgcgg

SEQ ID NO: 432088 - DNA, 519 bp, Homo sapiens
  misc_feature: GZ8MTXP02F8B0Y.38.38.D05.1.454.CMB.2.raw
  modified_base (348)..(348): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggctcctgacccatttcnggctcaggctgagacgaggctgaattttatgctctcatatacagcagcagcaccccttatgtcttcggaactgggaccaaaggtcaccgtcctacgtcagcccaaaggcccaaaccccactcgtccactctcgtttcccaccctcctcaacgtgactcgactgacgcggcg

SEQ ID NO: 432089 - DNA, 528 bp, Homo sapiens
  misc_feature: GZ8MTXP02JL4YG.38.38.D05.1.454.CMB.2.raw
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctcccctgaccccatttctgggctccaggctgaggacgaggctgaattttatgctctcatatacaggcagcacgctaccccttatcgtcttcggactgggaccaagggtcaccgtcctacgtcagcccaacggccaacccgactcgtccactctcgttcccgccctcctcaacgtcgactcgactcggacgcggcg

SEQ ID NO: 432090 - DNA, 524 bp, Homo sapiens
  misc_feature: GZ8MTXP02H7OPS.38.38.D05.1.454.CMB.2.raw
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccccatttctgggctccaggctgaggacgaggctgaattttatgctctcatatacaggcagcagcaccccttatgtcttcggaactgggaccaaggtcaccgtctacgtcacgcccaaggcccaaccccactcgtacactctacgttcccaccctcctcaacgtgactcgactcgacgcgggc

SEQ ID NO: 432091 - DNA, 515 bp, Homo sapiens
  misc_feature: GZ8MTXP02HMYGZ.38.38.D05.1.454.CMB.2.raw
  modified_base (343)..(343): a, c, t, g, unknown or other
  modified_base (355)..(355): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcattatgacgtcactcatcggcctcaggggtttctactcgcttctctggctccaagtttggcaacacgcctcctacatttcnggctcaggctgnggcgaggctgaattttatgctctcatatacaggcagcagcacccttatcgtcttcggaactgggaccaagggtcaccgtcctacgtcacgcccaaggccaaaccccactcgtcactctcgttcccaccctctccacgtcgactcgactgacgcggctcgg

SEQ ID NO: 432092 - DNA, 516 bp, Homo sapiens
  misc_feature: GZ8MTXP02F7ZL0.38.38.D05.1.454.CMB.2.raw
  modified_base (350)..(350): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctcctgacccatttcnggctcaggctgagacgaggctgtaattttatgctcctcatatacagcagcagcacccttatgtcttcggaactggaccaaggtcaccgtctacgtcacgcccaagcccaacccactcgtcactctcgttcccaccctcctcaacgtcgactcgactcgacgcggcg

SEQ ID NO: 432093 - DNA, 519 bp, Homo sapiens
  misc_feature: GZ8MTXP02IZERJ.38.38.D05.1.454.CMB.2.raw
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacacacccaggcaaagcccccaaactcatcatttatgacgtcactcatcggccctcaggggtttctactcgcttctctggctccaagtttggcaacacggcctccctgaccccatttctgggctcaggctggagacgaggctgaattttatgctcctcatatacaggcagcagcaccccttatgtcttcggaactgggaccagggtcaccgtctacgtcacgcccaagccaaccccactcgtcactctcgttcccaccctcctcaacgtcgactcgactcgacgcgggtc

SEQ ID NO: 432094 - DNA, 498 bp, Homo sapiens
  misc_feature: GZ8MTXP02JWA98.38.38.D05.1.454.CMB.2.raw
  modified_base (286)..(286): a, c, t, g, unknown or other
  modified_base (462)..(462): a, c, t, g, unknown or other
  modified_base (470)..(470): a, c, t, g, unknown or other
  modified_base (490)..(490): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcattatgacgtcactcatcggcctnagggtttctactcgcttctctggctcaagtttgcaacacgcctccctgaccccatttctgggctcagctgagacgaggctgaattttatgctctcatatacagcagcaagcacccttatgtcttgaactgggaccaaggtcacgtctacgcagcccaagccaacccactgcactcncgtccccncctctcaacgtcactcgacncgcgcgcg

SEQ ID NO: 432095 - DNA, 512 bp, Homo sapiens
  misc_feature: GZ8MTXP02GQXT7.38.38.D05.1.454.CMB.2.raw
  modified_base (225)..(225): a, c, t, g, unknown or other
  modified_base (435)..(435): a, c, t, g, unknown or other
  modified_base (445)..(445): a, c, t, g, unknown or other
tcagtcgatcacgtcacgaccggtgctcgatttagtatctgatagttgggtttggggggtctcaggaggcagcgctctcaggacatctccaccatggcctgggctctgctgctcctcaccctctcactcagggcacagggtcctgggcccagtctgccctggctcagcctgcctccgtgtctgggtctcctggacagtcgatcaccatctcctgcactggaaccngcagtgacgttggtggttataaattgtctctggtaccaacagcaccggcaatcgacccccaaaatcatgatttatgaggtcactcatcggccctcaggggtttctaatccgcttctctgcatcagtctggcaacacgcctcctgaccatctctggctccagctgacggacgaggctaaattatttctagtcagttcataactacaaacanacaacactcngctagttcggacggagggaccaagctcgaccgtaactaaagtcaacgcccaaaggcctacgcccccg

SEQ ID NO: 432096 - DNA, 505 bp, Homo sapiens
  misc_feature: GZ8MTXP02J0ALS.38.38.D05.1.454.CMB.2.raw
tcagtcgatcacgtcacgaccggtgctcgatttagtatctgatagttgggtttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttggtggttataactatgtctcctggtaccaacaacacccaggcaaagcccccaaactcatcattatgacgtcactcatcggccctcaggggttctacctcgcttctctgctcagtttggcaacacgcctccctgacccatttctgggctccaggctgaggacgaggctgtaattttattgctctcatatacaggcagcagcaccctatcgtcttcggaactcgggaccaggtcaccgtcacgtcacgccacggcccaacccactgacc

SEQ ID NO: 432097 - DNA, 535 bp, Homo sapiens
  misc_feature: GZ8MTXP02ID0G2.38.38.D05.1.454.CMB.2.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaaactcatcatttatgacgtcactcatcggccctcaggggtttcactcgcttctctggctcaagtttggcaacacggcctccctgacccctatttctcgggctccaggctggaggacgaggctgtaattttattgctcctcatatacaggcagcagccaccccttatgtccttcggaactgggaccaagggtccaccgtcctacgtcacgcccaagccaaccccactcgtccactctcgttccccgccctcctcaacgtcgactcgactcgacgcggtcg

SEQ ID NO: 432098 - DNA, 502 bp, Homo sapiens
  misc_feature: GZ8MTXP02GSC82.38.38.D05.1.454.CMB.2.raw
tcagtcgatcacgtcacgaccggtgctcgatttagtatctgatagttgggtttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaagcccccaaactcattattatgaggtccgaatcggcctcaggtattcctaatcgcttctctggctccaagtctggcaacacggcctccctgaccatctctggactccaggctgaggacgaggctgattactatgcagttcatatacaagcactactcctcttctgttacttcggcggacggaccgagggtcgaaccgtctaacgtcacgccaaggctcccg

SEQ ID NO: 432099 - DNA, 537 bp, Homo sapiens
  misc_feature: GZ8MTXP02JDM03.38.38.D05.1.454.CMB.2.raw
  modified_base (226)..(226): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaancagtagtgacattggtggttataactatgtctcctggtaccaacaacaccccaggcaaagcccccaaactcatcatttatgacgtcactcatcggccctcaggggtttctacctcgcttctctggctccagtttgcaacaccgcctccctgacctattctgggctccaggctgacggacgaggctgtaattttatgctcctcatatacaggcagcagcctacccttatcgtcgttacggaaccttcggggaacctaacgggtccaccggtccctaacgtcacgaccctaacgacccaaccctactcgtacc

SEQ ID NO: 432100 - DNA, 526 bp, Homo sapiens
  misc_feature: GZ8MTXP02FZOX1.38.38.D05.1.454.CMB.2.raw
  modified_base (324)..(324): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaagcagtagtgactattggtggttataactatgtctctgtaccaacaacacccaggcaaacgccccaaactcatcatttatgactcactcatcggccctnagggtttctacctcgcttctctgctcagtttcgcaacaccgcctcctcgacctatttctcggctccgaggctggaggtacgaggctagtaatttttagtcgcttcctactattactacaaggcaggcagcctacccttatcgtctacggactcggacaacggtctaccgctacgcacgccaacgcccaaacccactcgtacc

SEQ ID NO: 432101 - DNA, 518 bp, Homo sapiens
  misc_feature: GZ8MTXP02G7D9H.38.38.D05.1.454.CMB.2.raw
  modified_base (267)..(267): a, c, t, g, unknown or other
  modified_base (348)..(348): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttangacgtcactcatcggcctcaggggtttctactcgcttctctggctccaagtttggcaacacggcctcctgaccccatttcngggctccaggctgaggacgaggctgaatttatgctctcatatacagcagcagcaccctatcgtcttcggactgggaccaggtcaccgtcctacgtcacgcccaacggccaacccgactcgtacactcctcgttcccgctcctcaacgttcgactcgactcgacgcggtcg

SEQ ID NO: 432102 - DNA, 495 bp, Homo sapiens
  misc_feature: GZ8MTXP02JEOVR.38.38.D05.1.454.CMB.2.raw
  modified_base (223)..(223): a, c, t, g, unknown or other
  modified_base (299)..(299): a, c, t, g, unknown or other
  modified_base (415)..(415): a, c, t, g, unknown or other
tcagtcgatcacgtcacgaccggtgctcgatttagtatctgatagttgggtttgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtggttataactatgtctctgtaccaacaacacccaggcaaagccccaaactcatcatttangacgtcactcatcggcctcagggtttcactcgcttctctggctccagtttgcaacacgcctcctgacccatttctggctccaggctgaggacgaggctagaattttatgtctcctnatatacagcagcagcaccctatgtcttcggaactcgggaccaaaggtcacgtctacgcacgccagccaacccactgtacc

SEQ ID NO: 432103 - DNA, 576 bp, Homo sapiens
  misc_feature: GZ8MTXP02JH96V.38.38.D05.1.454.CMB.2.raw
  modified_base (225)..(225): a, c, t, g, unknown or other
  modified_base (305)..(305): a, c, t, g, unknown or other
  modified_base (380)..(380): a, c, t, g, unknown or other
  modified_base (424)..(424): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagtagtgacagttggtggttataactatgtctcctggtaccaacaacacccaggcaaacgccccaaactcatcatttangacgtcactcatcggcctcgtagggtttctacctcgcttctctgctcagttgcacacgcctcctgactatttcgnggctcgaggctgaggacgaggctagtaattttatcgtctccctnattatacgagcagctacgccctacccttagtcgttactttaccgggaacgttaccggggaacctaaaacggggttccaacccggttcccgttaaaccggtccgaaccggaccccaaacgggacccccaaacccccgaacgttcgtaaccccg

SEQ ID NO: 432104 - DNA, 532 bp, Homo sapiens
  misc_feature: GZ8MTXP02GT7OB.38.38.D05.1.454.CMB.2.raw
  modified_base (267)..(267): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaatcatcatttangacgtcactcatcggccctcgagggtttctactcgcttctctggctcaagtttggcaacacgcctccctgacccctatttctgggctccgaggctgaggacgaggctgtaatttatgctctcatatacagcagcacgcctacccttatcgtcttacggactgggacctaagggtccaccgtctacgtcacgcccaacgcccaaaccccactcgccactccttacgttccccaccctcctcaacgtcactcgactcgacgcggtcg

SEQ ID NO: 432105 - DNA, 530 bp, Homo sapiens
  misc_feature: GZ8MTXP02HBOQJ.38.38.D05.1.454.CMB.2.raw
  modified_base (267)..(267): a, c, t, g, unknown or other
  modified_base (344)..(344): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttangacgtcactcatcggccctcagggtttctactcgcttctctggctcagtttgcaacacgcctcctgacccctattcngggctcaggctgaggacgaggctgtaatttatgctctcatatacagcagcagcctacccttatcgtcttacggactggaccaggtcaccgtcctacgtcacgacccaacgcccaacccctactcgtaccaccttcctccgttccccgccctccctcaaccgtcgaactccgactcgacgcggtacg

SEQ ID NO: 432106 - DNA, 527 bp, Homo sapiens
  misc_feature: GZ8MTXP02IUS1P.38.38.D05.1.454.CMB.2.raw
  modified_base (189)..(189): a, c, t, g, unknown or other
  modified_base (347)..(347): a, c, t, g, unknown or other
  modified_base (501)..(501): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtgttataactatgtctcctggtaccaacaacacccaggcaaagcccccaaactcatcattatgacgtcactcatcggccctcaggggtttctactcgcttctctggctccaagtttggcaacacgcctcctgaccccatttcngggctccaggctggaggacgaggctgtaattttatgctcctcatatacaggcagcagcacccttatgtcttcggaacttggaccaggtcaccgtcctacgtcacgcccaacggcccaaaccccgactcgtccactcctcgttccccaccctccncaacgtgactcgactcgacgtcggcg

SEQ ID NO: 432107 - DNA, 504 bp, Homo sapiens
  misc_feature: GZ8MTXP02HE06T.38.38.D05.1.454.CMB.2.raw
  modified_base (337)..(337): a, c, t, g, unknown or other
  modified_base (474)..(474): a, c, t, g, unknown or other
  modified_base (483)..(483): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctctggtaccaacacaccaggcaaagccccaaatcatcattatgacgtcactcatcggcctcagggtttctactcgctctctggctcagtttggcacacggcctcctgacccattcngggctcgagctgagacgaggctgtaatttatgctctcatatacagcagcagcctacccttatgtcgttcgaacgttgggaccaaggtcacccgtctacgtcacgcccaaggcccaacccactcgtcactctcgtccncccgcctcncgcgacacgcacgtacgcgcg

SEQ ID NO: 432108 - DNA, 551 bp, Homo sapiens
  misc_feature: GZ8MTXP02G76HC.38.38.D05.1.454.CMB.2.raw
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacaacacccaggcaaagccccaaactcatcatttatgacgtcactcatccggccctcgaggggtttctactcgcttctctggctcaagtttgcacacgcctcctgacccctatttcgtggctccgaggctgaggacgaggtctagtaattttatgcctcctacatatacaggcagcacgcctaccccttatgtctttacggacgttagggacctaaggtccaacccgtccgtacgtcaacgaccccaaacggcccaaacccctactcgactacttctccgttacccaccctcctccaacgtcgactcgactcgacgcggtcg

SEQ ID NO: 432109 - DNA, 517 bp, Homo sapiens
  misc_feature: GZ8MTXP02JYZVY.38.38.D05.1.454.CMB.2.raw
  modified_base (389)..(389): a, c, t, g, unknown or other
  modified_base (464)..(464): a, c, t, g, unknown or other
  modified_base (498)..(498): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacacaccaggcaaacgccccaaactcatcatttatgacgtcactcatccggcctcaggggtttctactcgcttctctggctccaagtttggcaacacggcctccctgacccctatttcgtgggctcaggctgaggacgagctgtaattttatgctcctnatatacagcagcagccacccttatcgtctcggactggacaggtcaccgtcctacgtcacgcccaagcccaacccnctcgtacacgtctcgtcccaccctcctcaacgtnactcacgtcgacgcggtcg

SEQ ID NO: 432110 - DNA, 529 bp, Homo sapiens
  misc_feature: GZ8MTXP02I3TWZ.38.38.D05.1.454.CMB.2.raw
  modified_base (265)..(265): a, c, t, g, unknown or other
  modified_base (472)..(472): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacaacaccaggcaaacgccccaaactcatcattangacgtcactcatccggcctcgaggggtttcactcgcttctctggctcaagtttggcaacacgtcctcctgaccccatttctggctcgaggctgaggacgaggtctgtaattttatcgctcctctatatacagcagcacgcctacccttatcgtacttcggaactgggaccagggtcaccgtctacgtcacgcccaacgcccaacccnctcgccactcctcgttccccaccctccacaacgtcgactacgactcgacggcggtcg

SEQ ID NO: 432111 - DNA, 519 bp, Homo sapiens
  misc_feature: GZ8MTXP02G8LX6.38.38.D05.1.454.CMB.2.raw
  modified_base (343)..(343): a, c, t, g, unknown or other
  modified_base (496)..(496): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaatcatcatttatgacgtcactcatcggccctcaggggtttcactcgcttctctggctcaagtttgcacacgcctcctgacccattcnggctccaggctgaggacgagctgtaatttatgctctcatatacagcacgcagccaccccttatcgtcttacggaacttgggaccaagggtccaccgtcctacgtcacgcccaacgcccaacccgactcgcacctctccgtcccaccctccacncgtcgactcgactcgacgcggcg

SEQ ID NO: 432112 - DNA, 529 bp, Homo sapiens
  misc_feature: GZ8MTXP02HZZYF.38.38.D05.1.454.CMB.2.raw
  modified_base (345)..(345): a, c, t, g, unknown or other
  modified_base (362)..(362): a, c, t, g, unknown or other
  modified_base (383)..(383): a, c, t, g, unknown or other
  modified_base (499)..(499): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctctggtaccaacaacaccaggcaaagccccaaatcatcatttatgacgtcactcatcgccctcaggggtttctactcgcttctctggctccaagtttgcaacaccgcctcctgaccctatttcnggctcaggctgagacgnggctgtaatttattgctcctnatatacaggtcagcagcctacccttatcgtcttcggaacttgggaaccaggtccaccgtcctacgtcacgacccaaggcccaacccactcgtccactctcgttccccacccttccnctaaccgtcgactcgactcgacgcgggtcg

SEQ ID NO: 432113 - DNA, 526 bp, Homo sapiens
  misc_feature: GZ8MTXP02F1WC1.38.38.D05.1.454.CMB.2.raw
  modified_base (509)..(509): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgcccccaaactcatcatttatgacgtcactcatcggccctcgaggggtttctactcgcttctctggctccaagtttggcaacacggcctccctgacccctatttctgggctccaggctgaggacgaggctgtaattttatgctctcatatacagcagcagcctacccttatgtcttcggactgggaccaaggtcacccgtctacgtcacgcccaaggcccaacccactcgtcactctcgtcccaccctctacaacgtacncgactgacgcggctcgg

SEQ ID NO: 432114 - DNA, 525 bp, Homo sapiens
  misc_feature: GZ8MTXP02GHK4U.38.38.D05.1.454.CMB.2.raw
  modified_base (270)..(270): a, c, t, g, unknown or other
  modified_base (473)..(473): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgcccccaaactcatcatttangacgtcactcatcggccctcaggggtttcactcgcttctctggctccaagtttggcaacacggcctccctgaccccatttctgggctccaggctgagacgaggctgaattttatgctctcatatacagcagcagccacccttatcgtacttcggaactgggaccaggtcaccgtcctacgtcacgcccaacggcccaaacccnctcgccactctcgtcccacctcctacaacgtgactcgactcgacgcggtacg

SEQ ID NO: 432115 - DNA, 602 bp, Homo sapiens
  misc_feature: GZ8MTXP02GYC1I.38.38.D05.1.454.CMB.2.raw
  modified_base (225)..(225): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagtagtgactagttggtggttataactatgtctctggtaccaacaacaccaggcaaacgccccaaactcactcatttatgacgtcactcactccggcctcgtaggggtttctaccgtcgtcttctctggtccttctagtttcgactaaccgtaccggcccttcccgtcgtaaccctagtttccgtcggggtccttaccgaggtcgtggacgggacggaggtctacggttaaattttagttcgtccttccttactattactaacgaggtacagcacgtcctaacccctttagtcgttaccgttacggaaacgttcgggaaccgaacggtccacccgtctacgtcgacgtacccaacggcccaaccctactcgtaccc

SEQ ID NO: 432116 - DNA, 527 bp, Homo sapiens
  misc_feature: GZ8MTXP02HUKML.38.38.D05.1.454.CMB.2.raw
  modified_base (288)..(288): a, c, t, g, unknown or other
  modified_base (348)..(348): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaatcatcatttatgacgtcactcatcggccctnaggggtttctactcgcttctctggctccaagtttggcaacacgcctcctgacccatttcngggctcaggctgagacaggctgaattttatgctctcatatacaggcagcagcctaccccttatcgttcttcggaacttggggaaccaagggtccaccgtcctaacgtcacgcccaaggcccaacccgctacgtcactcgtctcccacctcctcaacgttgactcgactcgacgcggtcg

SEQ ID NO: 432117 - DNA, 541 bp, Homo sapiens
  misc_feature: GZ8MTXP02FJ3HS.38.38.D05.1.454.CMB.2.raw
  modified_base (350)..(350): a, c, t, g, unknown or other
  modified_base (410)..(410): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttatgacgtcactcatcggccctcaggggtttctactcgcttctctggctccaagtttggcaacacggcctccctgaccccattcnggctcaggctgagagaggctgaatttatgctcctcatatacaggcagcagcaaccccttntcgtcttcggaactgggaccaagggtcaccgtcctacgtcacgacccaacggcccaaaccccactcgtaccactccgttcgtcccccacccctcctccaacgtcgtactccgactacggacggcgggtacg

SEQ ID NO: 432118 - DNA, 532 bp, Homo sapiens
  misc_feature: GZ8MTXP02JWJWG.38.38.D05.1.454.CMB.2.raw
  modified_base (225)..(225): a, c, t, g, unknown or other
  modified_base (306)..(306): a, c, t, g, unknown or other
  modified_base (422)..(422): a, c, t, g, unknown or other
  modified_base (429)..(429): a, c, t, g, unknown or other
  modified_base (452)..(452): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagtagtgactagttggtggttataactatgtctctggtaccaacaacacccaggcaaacgcccccaaactcatcatttangactcactcatcggcctcaggggtttctacctcgcttctctggctcagtttggcaacacgcctcctgacctatttctggctcgaggctgaggacgagctgtaattttatgcttctnatactanacggcaggcacgcctacccttangttcgtacggacgtacgggacctaacggtccaccggttcctacgtcgacgacccgaacggccccaaccccactcgtaccc

SEQ ID NO: 432119 - DNA, 519 bp, Homo sapiens
  misc_feature: GZ8MTXP02G7Z28.38.38.D05.1.454.CMB.2.raw
  modified_base (266)..(266): a, c, t, g, unknown or other
  modified_base (341)..(341): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacaacaccaggcaaacgccccaaactcatcatttangacgtcactcatcggcctcaggggtttctactcgcttctctggctcaagtttgcacacgcctcctgacccattcnggctcaggctgacggacgaggctgtaattttatgctctcatatacaggcagcagccaccccttatgtcttacggactgggaccaggtcaccgtctacgtcacgccaacggcccaacccactcgtcacttactcgttcccaccctcctaccaacgtcgactcgactcgacggcggtccg

SEQ ID NO: 432120 - DNA, 530 bp, Homo sapiens
  misc_feature: GZ8MTXP02JP95K.38.38.D05.1.454.CMB.2.raw
  modified_base (505)..(505): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctctggtaccaacaacacccaggcaaagccccaaactcatcatttatgacgtcactcatcggcctcaggggtttctactcgcttctctggctcaagtttggcacacggcctccctgacccctatttctgggctccaggctgaggacgaggctgtattttatcgctcctcatatacagcagcagctaccccttatcgtctacggactgggaccaaggtccaccgtccacgtcacgcccaaggcccaaccccactcgtccactcctacgttccccaccctccctacncgtcgactcgactcgacggcggtcg

SEQ ID NO: 432121 - DNA, 527 bp, Homo sapiens
  misc_feature: GZ8MTXP02HWXA9.38.38.D05.1.454.CMB.2.raw
  modified_base (268)..(268): a, c, t, g, unknown or other
  modified_base (288)..(288): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaatcatcatttangacgtcactcatcggccctnaggggtttctacttgcttctctggctccaagtttggcaacacggcctcctgacccctatttctgggctccaggctggaggacaggctagtaattttattgctctcatatacagcagcagccaccccttatgtcttcggaactgggaccaagggtccaccgtcctacgtcacgcccaaggcccaaacccactcgtcactctcgttcccacctcctcaacgtgactcgactcgacgtcggc

SEQ ID NO: 432122 - DNA, 522 bp, Homo sapiens
  misc_feature: GZ8MTXP02GTAOO.38.38.D05.1.454.CMB.2.raw
  modified_base (210)..(210): a, c, t, g, unknown or other
  modified_base (215)..(215): a, c, t, g, unknown or other
  modified_base (391)..(391): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttanaactntgtctctgtaccaacaacaccaggcaaacgccccaaactcatcatttatgacgtcactcatcggcccctcgaggggtttctactcgcttctctggctcaagtttggcaacacgcctcctgacccctattctggctcgagctgaggacgagtctgtaatttatgctctcatatcagnagcagcctacccttatgtcttacggaactcgggaccaagggtccaccgtcgtacgtcacgacccaaggcccaacccactcgtcctactcctcgtccccgtcctcctcaacgtcactcgactcgcgtcggcg

SEQ ID NO: 432123 - DNA, 539 bp, Homo sapiens
  misc_feature: GZ8MTXP02HQKCE.38.38.D05.1.454.CMB.2.raw
  modified_base (266)..(266): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaaggcccccaaatcataattangacgtcagtagtcggccctcgaggggtttctgatcgcttctcaggctccaagtctggcaacacggcctcctgaccccatctctgggctccaggttgaggacgaggctgactattatgcgctcacatgatcgaggtagggtttcggacggtagggaccaaaggtcgaccgttctaggtcacgcccaaggctcgcccccgtcggtccacgtcctcgttccccgccctcctccacgtcgacttccgactggacgcgggcgtcggacgacggcgacg

SEQ ID NO: 432124 - DNA, 549 bp, Homo sapiens
  misc_feature: GZ8MTXP02GPKWV.38.38.D05.1.454.CMB.2.raw
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgcccccaaactcatcatttatgacgtcactcatcggccctcaggggtttctactcgcttctctggctccaagtttggacaacacggcctccctgacccctatttctcgggctccaggctgaggacgaggctgtaattttatcgctcctcatatacagcagcacgcctaccccttatcgtcttacggaacgttgggaccaaggtccaccgtacctacgtcacgcccgaacggcccaacccctactcgtactacttcctcgttccccaccctcctccaacgtcactcgactcgacgtcggcg

SEQ ID NO: 432125 - DNA, 521 bp, Homo sapiens
  misc_feature: GZ8MTXP02I5B68.38.38.D05.1.454.CMB.2.raw
  modified_base (263)..(263): a, c, t, g, unknown or other
  modified_base (487)..(487): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacaacaccaggcaaagccccaaactcatcattangacgtcactcatcggcctcagggtttctactcgcttctctggccccaagtttggcaacacggcctccctgaccatttctgggctccaggctgaggacgaggctagtaattttatgctcctcatatacaggcagcagcacccttatcgtcttcggaactcgggaccaagggtcaccgtcctacgtcacgcccaacggcccaaacccgctcgtcactctcgtcccnccctcctcacgtcgacgctcgacgcggctggacg

SEQ ID NO: 432126 - DNA, 514 bp, Homo sapiens
  misc_feature: GZ8MTXP02JMUWA.38.38.D05.1.454.CMB.2.raw
  modified_base (238)..(238): a, c, t, g, unknown or other
  modified_base (267)..(267): a, c, t, g, unknown or other
  modified_base (343)..(343): a, c, t, g, unknown or other
  modified_base (355)..(355): a, c, t, g, unknown or other
  modified_base (378)..(378): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaaccaaaacncccaggcaaagccccaaatcatcatttangacgtcactcatcggcctcaggggtttcactcgcttctctggctcaagtttggcaacacggcctcctgacatttcnggctcaggctgngacgaggctgaattttatgctcncatatacaggcagcagcaccctatcgtctcggaactgggaccaaggtccaccgtcctacgtcacgcccaaggcccaacccactcgtccactctcgttcccgccctccgtcacgtgactcgactgacgcgggctcgg

SEQ ID NO: 432127 - DNA, 517 bp, Homo sapiens
  misc_feature: GZ8MTXP02F6AJ8.38.38.D05.1.454.CMB.2.raw
  modified_base (424)..(424): a, c, t, g, unknown or other
  modified_base (509)..(509): a, c, t, g, unknown or other
tcagtcgatcacgtcacgaccggtgctcgatttagtatctgatagttgggtttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacaccaggcaaacgcccccaaactcatcatttatgacgtcactcatcggccctgacggggtttctacctcgcttctctgctcctagtttgacaacacgcctcctgacctatttctcggctccaggctgaggacgagctagaattttatgctcctnatatacagcagcaagcctacccttatcgtctacggacttgggaaccacggtccacgtcctacgcacgacccaaggcccaaacccnctacgtcc

SEQ ID NO: 432128 - DNA, 514 bp, Homo sapiens
  misc_feature: GZ8MTXP02FORF8.38.38.D05.1.454.CMB.2.raw
  modified_base (267)..(267): a, c, t, g, unknown or other
  modified_base (350)..(350): a, c, t, g, unknown or other
  modified_base (379)..(379): a, c, t, g, unknown or other
  modified_base (385)..(385): a, c, t, g, unknown or other
  modified_base (460)..(460): a, c, t, g, unknown or other
  modified_base (480)..(480): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaccaacaacacccaggcaaacgccccaaactcatcatttangacgtcactcatcggccctcaggggtttcactcgcttctctggctccaagtttggcaacacggcctccctgacccctatttcngggctcaggctgagcgaggctgtaatttntgctcncatatacagcagcagcacccttatgtcttacgactggacaaggtcacgtctacgtcacgcccaagcccaaacccnctgtccactcctcgttcccnccctcctcaacgtcgactcgactcgacgcggtcg

SEQ ID NO: 432129 - DNA, 534 bp, Homo sapiens
  misc_feature: GZ8MTXP02GVPBI.38.38.D05.1.454.CMB.2.raw
  modified_base (424)..(424): a, c, t, g, unknown or other
tcagtcgatcacgtcacgaccggtgctcgatttagtatctgatagttgggtttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttatgactcactcatcgcctcagggttctacctcgcttctctggctccagtttgctaacacggcctccctgaccctatttcgtcggctccgaggctgaggacgaggctgaattttatgtctcctnatatacaggcagcagccaccccttatcgttcttacggaacgttcgggaaccaagggttccacccgttcctacggtcacgaccccgaacggacccaacccgactcgtaccc

SEQ ID NO: 432130 - DNA, 569 bp, Homo sapiens
  misc_feature: GZ8MTXP02HC55U.38.38.D05.1.454.CMB.2.raw
  modified_base (227)..(227): a, c, t, g, unknown or other
  modified_base (236)..(236): a, c, t, g, unknown or other
  modified_base (260)..(260): a, c, t, g, unknown or other
  modified_base (361)..(361): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataattgtctctgtacanagcaccggnaatcgaccccaaatcatgatttangagtcactcatccggccctgtagggtttctaatcgtctttctctgcatccaagtctggacaacgaccggccctccctcgacctatctcgtcgggcctccgnggctggacggacgaggtacttaatttattctgctagttcatactaacgaaccagaccaacactctgtacttagtcgggacggaggaccgaagcctacgacccgtactaacgtccacgacccgaacgtccgtccgtcccccgtacggtcctaccgttccgtccgttcccgtcctcccgtccttaccgacgtcgacttccggacgtcggg

SEQ ID NO: 432131 - DNA, 543 bp, Homo sapiens
  misc_feature: GZ8MTXP02H4VI9.38.38.D05.1.454.CMB.2.raw
  modified_base (402)..(402): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttaataactatgtctcctggtaccaacaacacccaggcaaacgccccaaactcatcatttatgacgtcactcatcggccctcgaggggtttctactcgcttctctggctcctaagtttcggacaacacggcctcctgacccctattctggctcaggctgaggacgaggctagtactttattgctctcatatacngcagcagcctacccttatgttcttacggaacgttgggacctaacggtccaccgtacctacgtcgacgacccaacgccaaccccactcgtaccactctcttccccacccttcctcaacgttcgactcgacgtcgacgcggcg

SEQ ID NO: 432132 - DNA, 535 bp, Homo sapiens
  misc_feature: GZ8MTXP02JGPFL.38.38.D05.1.454.CMB.2.raw
  modified_base (190)..(190): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtggttataactatgtctcctggtaccaacaacacccaggcaaacgcccccaaactcatcatttatgacgtcactcatcggcccctcgagggtttctactcgcttctctggctccaagtttggcaacacgcctcctgaccccatttctggctccaggctgaggacgagctgaatttttatgtctctcatatacagtcagcagccacccttatgtcttcggaactgggaccagggtcaccgtcctacgtcacgcccgaacgcccaaccccgactcgtcaacctctccgttcccaccctcctcgaacgtcgtaactcgactcgacggcggtcg

SEQ ID NO: 432133 - DNA, 565 bp, Homo sapiens
  misc_feature: GZ8MTXP02H6LGI.38.38.D05.1.454.CMB.2.raw
  modified_base (189)..(189): a, c, t, g, unknown or other
  modified_base (354)..(354): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtgttataactatgtctcctggtaccaacaacacccaggacaaacgcccccaaactcatcattatgacgtcactcatcggcctcgagggtttctactcgcttctctgactcctaagtttggcaacacggtcctccctgaccctatttccgngggccttccgaggctggacgggacgagggtctagtaattttacttgacctcctctacttactacaggtcacgcaacgccctaccccttatcggtactttcggaacgtgggaccaaggtccaaccgttccacgtcacgccccaagcccaacccatcgcactccgtcttccccaccttccactaaccgtcgactaccgactcggacgtcggcg

SEQ ID NO: 432134 - DNA, 555 bp, Homo sapiens
  misc_feature: GZ8MTXP02JXLPX.38.38.D05.1.454.CMB.2.raw
  modified_base (264)..(264): a, c, t, g, unknown or other
  modified_base (524)..(524): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctgtaccaacaacaccaggcaaacgccccaaactcatcatttangacgtcactcatcggccctcaggggtttctactcgcttctctggctccagtttggcaacaccggcctccctgacccctatttctgggcctcgaggctggagacgaggctgtaatttttatgctcctacatactacaggcagcagcctacccttatcgttcttacggaacgttcgggaacctaaggtccaccgttaccgtacgttcacgcccaaggcccaaaccccgtactcgtccacttccgtcgttccccgcccttccncctaacgtctacgtcgactcggacgtcggcg

SEQ ID NO: 432135 - DNA, 551 bp, Homo sapiens
  misc_feature: GZ8MTXP02J0IM7.38.38.D05.1.454.CMB.2.raw
  modified_base (269)..(269): a, c, t, g, unknown or other
  modified_base (406)..(406): a, c, t, g, unknown or other
  modified_base (428)..(428): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaacgccccaaactcatcatttangacgtcactcatccggcctcaggggtttctactcgtcttctctggctccaagtttggacaacacggcctccctgacccctatttctgggcctcgaggctgaggacgagctgtaattttatgccttctcatactaacnggcagcacgcctacccctttancgttcttcggaacgtcgggaccaagggtcaccggtcctacgtcacgcccaacgcccaaccctctcgtcacgtcctcgttaccccacctcctcaacgtacgactccgacgtcgacggcggtacg

SEQ ID NO: 432136 - DNA, 554 bp, Homo sapiens
  misc_feature: GZ8MTXP02GY5H2.38.38.D05.1.454.CMB.2.raw
  modified_base (230)..(230): a, c, t, g, unknown or other
  modified_base (239)..(239): a, c, t, g, unknown or other
  modified_base (421)..(421): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataatttgtctctgtacaanagcaccggnaatcgaccccaaaatcatgattatgaggtcactcatcggccctcaggggtttctaatcgctttctctgcatccaagtctggacaacacggcctcctcgaccatctctcgggcctccgaggtctggacggacgaggtacttaatttatttctgtctagttcataactacaaaccagacaaacnctactgacttagttcgggacgtacggaccaagcgtacgaccgtactaaagcacgcccgaacggcctccgacccctcggtccaccttctccgttccccgccctccgttccgacgttcacgtcgacgtggaccgg

SEQ ID NO: 432137 - DNA, 530 bp, Homo sapiens
  misc_feature: GZ8MTXP02FEHF2.38.38.D05.1.454.CMB.2.raw
  modified_base (265)..(265): a, c, t, g, unknown or other
  modified_base (347)..(347): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttatactatgtctcctgtaccaacaacacccaggcaaagccccaaactcatcatttangacgtcactcatcggccctcaggggtttctactcgcttctctggctccaagttggcaacacggcctccctgaccccatttcngggctccaggctgaggacgaggctgtaattttatgctcctcatatacaggcagcagccaccccttatgtcttacggaactgggaccaagggtcacccgtcctacgtcacgacccaacggcccaaaccccactcgtctactctcgttccccgccctcctcaacgtgactcgactcgacgcggcg

SEQ ID NO: 432138 - DNA, 585 bp, Homo sapiens
  misc_feature: GZ8MTXP02IE7QC.38.38.D05.1.454.CMB.2.raw
  modified_base (225)..(225): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctggctcagcctgcctcgtgtctggtctcctggacagtcgatcaccatctcctgcactggaaccngcagtgacgttggtgttataatttgtctctggtaccaacagcacccggcaatcgacccccaaaatcatgatttatgagtcactcatcggccctcgaggggtttctaatccgctttctctgctatccagtctggaccaacgaccggccctccctcgacccatcctctgggctcccgaggcctgacggacgaggctaaagtttatttctgtctagtttcattactaacaacagactaaacacctctacgtacttacgttaccgggacgggaacgggaacccgaaacggtccgtacgtaaccccggttaaccgtaaacggtaccaaccggaccccaaacggggtccctaccggtcccccccgg

SEQ ID NO: 432139 - DNA, 532 bp, Homo sapiens
  misc_feature: GZ8MTXP02HZPDC.38.38.D05.1.454.CMB.2.raw
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataaatatgtctcttggtaccaacatcaccaacatcacccaggcaaagtccccaaactcataatttatgaggtcactaaacggccctcaggagtttctaaatcgcttctctggctccaagtctggcacaccggcctccctgaccatctctggggctccaacctgaggacgaggctcactattattgcagctcatatacaagcagcgtcactttgggtgttcgggcggagggaccgaccgtgaaccgtcgttaggtcgacgtcccaaaggcctcgccccctcggtccactctcgttcccaccctcctcacgtcgactcgtaccg

SEQ ID NO: 432140 - DNA, 538 bp, Homo sapiens
  misc_feature: GZ8MTXP02G6375.38.38.D05.1.454.CMB.2.raw
  modified_base (272)..(272): a, c, t, g, unknown or other
  modified_base (394)..(394): a, c, t, g, unknown or other
  modified_base (486)..(486): a, c, t, g, unknown or other
  modified_base (490)..(490): a, c, t, g, unknown or other
  modified_base (509)..(509): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacatttgggtgttaataactatgtctctggtaaccaacaaccacccaggacaaacgcccccaaatcatcattangactcactcatccggcctcgagggtttctactcgcttctctggctcagtttgcaacacgcctcctgaccctattctgggctccgaggctggaggacgaggtctagtattttatcgtctcctnatatacgagcagcacgtcctacccttatcgtcgttacggagttacgggaacctacggtccaaccgtctacgtcacgacccacgcccaacccngtcncactctcctcccaccctcnctaacgtgtactcgactcgacggcggtcg

SEQ ID NO: 432141 - DNA, 520 bp, Homo sapiens
  misc_feature: GZ8MTXP02G9PM8.38.38.D05.1.454.CMB.2.raw
  modified_base (190)..(190): a, c, t, g, unknown or other
  modified_base (395)..(395): a, c, t, g, unknown or other
  modified_base (475)..(475): a, c, t, g, unknown or other
  modified_base (503)..(503): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtgttataactatgtctcctggtaccaacaacacccaggcaaacgcccccaaatcatcatttatgacgtcactcatcggccctcagggtttctactcgcttctctggctcaagtttggcaacacgcctcctgacccctatttctgggctcgaggctggagacgaggctgtaattttatgctctcatatacngcagcacgcctaccccttatcgtcttacggaactgggacctaaggtccaccgtctacgtcacgcccaagccaaacccctntcgcactctcgtcccacctctcaacgtnactcgactgacgcggtc

SEQ ID NO: 432142 - DNA, 592 bp, Homo sapiens
  misc_feature: GZ8MTXP02F1YGS.38.38.D05.1.454.CMB.2.raw
  modified_base (357)..(357): a, c, t, g, unknown or other
  modified_base (410)..(410): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctgtaccaacaacaccaggcaaacgccccaaactcatcatttatgacgtcactcactccggccctcgtaggggtttctactcgcttctctggctcctaagtttggacaacaccggcctccctgacccctatttcgngggctcgaggctggaggacgaggctagttaattttatcgtctctcatactacngacagcacgcctacccttatcgttcgttaccggaacgtcgggaaccgtacggtaccgacccgtcgtaacgtcacgacccgaaacggaccccaaaccccgtactcgtacctaccttcgttaccgttcccctacccctcctacctaacggttcaacgtccgacgttacggacggtccgggtcgg

SEQ ID NO: 432143 - DNA, 521 bp, Homo sapiens
  misc_feature: GZ8MTXP02FJSPH.38.38.D05.1.454.CMB.2.raw
  modified_base (298)..(298): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaaggcccccaaactcataatttatgacgtcagtagtcggccctcaggggtttcngatcgcttctcaggctccaagtctggcaacacgcctccctgaccccatctctgggctccagggttcgaggacgaggctgactattattgcgctcacatgatcgaggagggtttcggcggagggacaaagtgacgtcgtaggtcagcccgaaggctcgcccctcggtcactctcgttcccgccctcctcacgtcgactcgactgacgtcggctggcacggcacg

SEQ ID NO: 432144 - DNA, 515 bp, Homo sapiens
  misc_feature: GZ8MTXP02GQKT4.38.38.D05.1.454.CMB.2.raw
  modified_base (267)..(267): a, c, t, g, unknown or other
  modified_base (349)..(349): a, c, t, g, unknown or other
  modified_base (465)..(465): a, c, t, g, unknown or other
  modified_base (498)..(498): a, c, t, g, unknown or other
  modified_base (506)..(506): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaccaacaacacccaggcaaacgccccaaactcatcatttangacgtcactcatcggccctcgagggtttctactcgcttctctggctcaagtttggcaacacgcctccctgacccctatttcnggctcaggctgaggacgaggctgtaattttatgctctcatatacagcagcagccacccttatgtcttcggaactgggacaaggtcaccgtctacgcacgaccaacgcccaaacccnctcgcacctctcgttcccacctcctcaaccgtnactcgacncgacgcggc

SEQ ID NO: 432145 - DNA, 608 bp, Homo sapiens
  misc_feature: GZ8MTXP02GNYU7.38.38.D05.1.454.CMB.2.raw
  modified_base (414)..(414): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttggtagttaataactatgtctcctgtaccaacaacacccagaccaaacgccccaaatcatacatttatagacgtcactcactccggccctcgtagggtttctactcgtcttctctcggtcctacgtagtttcggaccaaccgaccggcctccctcgacccctatttcgtcgggtcctcgaggctggacggacgaggtctagttaaatttntcgcttccgtacaatatacgaggacacgacacgtacctacccttagtcgttacgttacggaacgtcgggacctaaacgggtccacccgtaccacgtacgacgacccgaacgaccccaaccccgtgtccgtccactcctcgttacccccaccttccgtacaaccgtcggtactaccgacgtacggacgcggtacg

SEQ ID NO: 432146 - DNA, 536 bp, Homo sapiens
  misc_feature: GZ8MTXP02JCETH.38.38.D05.1.454.CMB.2.raw
  modified_base (346)..(346): a, c, t, g, unknown or other
  modified_base (358)..(358): a, c, t, g, unknown or other
  modified_base (384)..(384): a, c, t, g, unknown or other
  modified_base (396)..(396): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacacacccaggcaaagccccaaactcatcatttatgacgtcactcatcggccctcaggggtttcactcgcttctctgccccaagtttggcaacacggcctccctgaccatttcnggctccagctgnggacgaggctgaattttatgctcctnatatacaggcancagcaccccttatcgtcgttcggaactgggaccaaggtccaccgtcctacgtcacgaccaggcccaaccccgactcgtaccactctccgttcccgcccctcctccacgtcgtaccgaacgtcgacgtcgggctggaaccg

SEQ ID NO: 432147 - DNA, 510 bp, Homo sapiens
  misc_feature: GZ8MTXP02GIICP.38.38.D05.1.454.CMB.2.raw
  modified_base (221)..(221): a, c, t, g, unknown or other
  modified_base (299)..(299): a, c, t, g, unknown or other
  modified_base (317)..(317): a, c, t, g, unknown or other
  modified_base (361)..(361): a, c, t, g, unknown or other
  modified_base (372)..(372): a, c, t, g, unknown or other
  modified_base (404)..(404): a, c, t, g, unknown or other
  modified_base (411)..(411): a, c, t, g, unknown or other
  modified_base (435)..(435): a, c, t, g, unknown or other
  modified_base (475)..(475): a, c, t, g, unknown or other
tcagtcgatcacgtcacgaccggtgctcgatttagtatctgatagttgggtttgggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcaccatctcctgcactggaancagtagtgacatttggtggttataactatgtctcctggtaccaacaacaccaggacaaagccccaaatcatcatttangacgtcactcatcgcctnagggtttctacctcgcttctctgctcagttgcaacacgcctccngacctatttcnggctccagctagagacgagctagaatttttangctcctnatatacagcagcacgcacccttancgtcttacgaactggaccctaaggtccaaccgtcctaacncgaacgcccaaaacggcccaaacccacttcgaacc

SEQ ID NO: 432148 - DNA, 516 bp, Homo sapiens
  misc_feature: GZ8MTXP02FI4Z9.38.38.D05.1.454.CMB.2.raw
  modified_base (268)..(268): a, c, t, g, unknown or other
  modified_base (348)..(348): a, c, t, g, unknown or other
  modified_base (467)..(467): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttangacgtcactcatcggcctcaggggtttctactcgcttctctggctccaagtttggcaacacggctccctgacccatttcnggctccagctgagacgaggctgaatttatgctctcatatacagcagcagcaccctatagtcttcggaactgggaccaaagggtcaccgtcctacgtcacgcccaagacccaacccactntccactctcttcccaccctcctacaacgtcacgtcgactcgacgcgggc

SEQ ID NO: 432149 - DNA, 504 bp, Homo sapiens
  misc_feature: GZ8MTXP02IV2YM.38.38.D05.1.454.CMB.2.raw
  modified_base (470)..(470): a, c, t, g, unknown or other
  modified_base (489)..(489): a, c, t, g, unknown or other
tcagtcgatcacgtcacgaccggtgctcgatttagtatctgatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctgtaccaacaacacccaggcaaagcccccaaaactcatcatttatgacgtcactcatcggccctcaggggtttcactcgcttctctggctccaagtttggcaaacacgcctcctgaccccatttctgggctcaggctgagacgagctgaattttatgctctcatatacagcagcagcaccctatgtcttggaactggaccaaggtcaaccgtctacgtcacgccaaagccaaacccactgtccattctntcccaccctcctcaacgtnatcgactgacgcggc

SEQ ID NO: 432150 - DNA, 920 bp, Homo sapiens
  misc_feature: GZ8MTXP02H0Q2P.38.38.D05.1.454.CMB.2.raw
  modified_base (190)..(190): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtggttaataactatgtctcctggtaccaacaacaccaggcaaacgcccccaaatcatcatttatgacgtcactcactccggccctcgtaggggtttcctacgtcgtctttcctctcggcctaccgtaaaggttttcggacctaaaccgaccggtcccctcccgtacgtaccccctagttttccgtcggggccttccgaacgggtccgttggggaacggggtaaccggtacggggtaccgtttaaggtttaaaactttttttacgtttccggtaccctttccccgttacgtaaactttaacgttaaacccggtaacgggggtacctaaaccgggtccaaacccggtaccccctttaaaccccccgttttaagttccgggtttaccccggtttttaaaccgggggaaaacccggttttaccgggggaaacccccgttaaaacgggggtttccccctaaacccccggggtttaccccgttaaaaccggttccccggaaaccccgggtaaaccccccggtaaaacccggggtaacccccccgaaaaaccccccctaccgtttccggtttaccccctaaaccccgtttccccggtttacccccggtttaccccccccggtaccccctttacccccgtccccgttaaaacccggtccgttaaaacccggtttccccggaaaaccggtttccggggaaccggggttaccccgggggtacccg

SEQ ID NO: 432151 - DNA, 552 bp, Homo sapiens
  misc_feature: GZ8MTXP02JQJVL.38.38.D05.1.454.CMB.2.raw
  modified_base (268)..(268): a, c, t, g, unknown or other
  modified_base (517)..(517): a, c, t, g, unknown or other
  modified_base (527)..(527): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaaccaacaacaccaggcaaacgcccccaaatcatcatttangacgtcactcactccggcctcgtaggggtttctactcgtcttctctggctctaagtttggacacacggcctcctgacccctatttcgtcgggcctccgaggctggacggacgaggtctagtaattttattcgctcctactatactacaggcagcacgcctacccttatcgtacgttacggacgtggaccaggtccaccgtcctacgtcacgacccgagaccccaaaccgtctcgtcactcctcgtcccnccctcctccncgtcgactcacgtcgcggacgtcgg

SEQ ID NO: 432152 - DNA, 567 bp, Homo sapiens
  misc_feature: GZ8MTXP02HRDH7.38.38.D05.1.454.CMB.2.raw
  modified_base (190)..(190): a, c, t, g, unknown or other
  modified_base (270)..(270): a, c, t, g, unknown or other
  modified_base (360)..(360): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtgttataactatgtctcctggtaccaacaacacccaggccaaacgcccccaaactcatcatttangacgtcactcatcgcctcgtagggtttctactcgcttctctggctcctaagtttggacaacaccggtccctcctgacccctagtttccgngggcctcgaggctgacggacgagctagtaattttatcgctcctacatactacagcagcgacgaccctaccccttatcgttccgttacggaacgtgggaacctaacgggtaccaccgttcctacgtcgacgcccgaacgccccaaacccgctacgtcacctcgtaccgttcccgccctctcaagttcgactcgactcggacgcggtcg

SEQ ID NO: 432153 - DNA, 525 bp, Homo sapiens
  misc_feature: GZ8MTXP02F1BDX.38.38.D05.1.454.CMB.2.raw
  modified_base (410)..(410): a, c, t, g, unknown or other
  modified_base (466)..(466): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctggtaaccaacaacacccaggcaaacgccccaaactcatcatttatgacgtcactcatcggccctcaggggtttctactcgcttctctggctccaagtttgcaacacgcctcctgacccctatttctcgggctccgagctgagacgagctgtaattttatgctctcatatacagcagcagcacccttntcgtctcggaacgtggaccaaggtcacccgtccacgtcacgccaaggcccaacccngtcgtccactcttccgtcccaccctcccacaacgtcgactacgactcgacggtcggacg

SEQ ID NO: 432154 - DNA, 633 bp, Homo sapiens
  misc_feature: GZ8MTXP02IVU02.38.38.D05.1.454.CMB.2.raw
  modified_base (294)..(294): a, c, t, g, unknown or other
  modified_base (304)..(304): a, c, t, g, unknown or other
tcagtcgatcacgtcacgaccggtgctcgatttagtatctgatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtggaagcaagtagtgactagttggtagttataactatgtctctgtaccaacaacaccagacaaacgccccaancatctattangacgtcactcactccggcctacgtagggtttctaccgtcgtctctctgtcttactagtttcgactaaccgaccgtccctccgtacgtacctactttcgtcgggtcctccggaggcgttaggacgggtaacggacggtacttagttaaacttttacgttcgtaccttaccttactaacttacgtaacgacggacgacgacgtactacctaccctttagttcgttaccgttacggtaaaccgtacgggtaaacctaacggtacccgtaaccgttaccgtaacgtaaccgaccgaacccgaacccggaacccaaccccgtactacgtaaccc

SEQ ID NO: 432155 - DNA, 585 bp, Homo sapiens
  misc_feature: GZ8MTXP02INVY1.38.38.D05.1.454.CMB.2.raw
  modified_base (267)..(267): a, c, t, g, unknown or other
  modified_base (392)..(392): a, c, t, g, unknown or other
tcagtcgatcacgtcacgaccggtgctcgatttagtatctgatagttgggtttgggggctttgcctcggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctctgtaccaacaacaccaggacaaacgccccaaactcatcatttangacgtcactcatccggccctcgtaggggtttctactcgcttctctggctctagtttggacaacgacgcctcctcgaccctacttctcggcctcgaggctggagacgagtctgtaatttatgctcnctatatacgagcagcacgcctacccttatcgtcgttacggaacgtgggaacctagggtacctaccgtcctacgtccacgacccaacggaccccaaaccccgtacgtacgtacctaccgttccgtcccgtttcccccgccccttcccgtaccgtaacggttcgaccgtacggacgtacggacggtcgggtaccg

SEQ ID NO: 432156 - DNA, 475 bp, Homo sapiens
  misc_feature: GZ8MTXP02FZCUX.38.38.D05.1.454.CMB.2.raw
  modified_base (263)..(263): a, c, t, g, unknown or other
  modified_base (282)..(282): a, c, t, g, unknown or other
  modified_base (286)..(286): a, c, t, g, unknown or other
  modified_base (289)..(289): a, c, t, g, unknown or other
  modified_base (296)..(296): a, c, t, g, unknown or other
  modified_base (445)..(445): a, c, t, g, unknown or other
  modified_base (460)..(475): a, c, t, g, unknown or other
tcagtcgatcacgtcacgaccggtgctcgatttagtatctgatagttgggtttgggggctttgcctgggtgttgttggtaccagtagtgacattggtggttataactatgtctcctggtaccaacaacaccccaggcaaagcccccaaactcatcatttatgacgtcactcatcggccctcaggggtttctactcgcttctctggctccaagtttggcaacacggccctccctgaccatttctgggctccaggctgaggacgngctagtatttatgctcctnatanagngcagcanccctacccttatcgttctacggaacgtcggaacctaaggtccaccgtcctacgtcaccgacccgaccggaccccaaacccctatccgtacctaccttccgtccgttccccccacccttcctccgactgactccgactggacggtcgcgnggacccaggccatannnnnnnnnnnnnnnn

SEQ ID NO: 432157 - DNA, 693 bp, Homo sapiens
  misc_feature: GZ8MTXP02HCPMC.38.38.D05.1.454.CMB.2.raw
  modified_base (221)..(221): a, c, t, g, unknown or other
  modified_base (273)..(273): a, c, t, g, unknown or other
  modified_base (376)..(376): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtggaagcagtagtgacagtttggtagttaataactntgtctcgtagtaccaacaacaccaggacaaacgccccaaactcatctattanagacgtcactcatccgcctgagtttcggtttctactcgtcttctcgtcggtctaccgtaagtttcggaccaaccgaccggtccctcctacgacctacgtttcncggtacctccgacggtcgtaggacggacggagtcttagtaaatttttacgtcgtccttacctactatactaacgagcagacaccgtaccctaaccccgtttagtaccggttaccgttaaccgggtaacgttaccggggaaaccttaaacgggtccctaacccgggttacccgttaaccgtaccgaacccgaaccccgaaaaccggaccccctaaaaccccgtccgttacgtaccctaccttacccgttccccttccccctacccttaacccgtccgtaccggtactaccgttaccgacgttaaccgggacgtccggg

SEQ ID NO: 432158 - DNA, 596 bp, Homo sapiens
  misc_feature: GZ8MTXP02IU69G.38.38.D05.1.454.CMB.2.raw
  modified_base (224)..(224): a, c, t, g, unknown or other
  modified_base (383)..(383): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcaccatctcctgcactggaancagtagtgactagttggtggttataactatgtctctgtaccaacaacacccaggacaaacgccccaaactcatctatttatgacgtcactcatccggcctcgtagggtttctacctcgcttctctgctcagtttgcacgacgcctcctgacctattcgnggtactcgaggctaggacggacgagtcgtagtaattttagttcgtacttcctctattataccgaggcagcaacgtcctaaccctttatcgtttacgttacggtaaacgttcggggaaacctaacggggttccctaaaccggttcccttaacggttaacccgaccggaccccgaaaaccggacccctaaaacccccgtacttccggtttaaccc

SEQ ID NO: 432159 - DNA, 570 bp, Homo sapiens
  misc_feature: GZ8MTXP02GGGOF.38.38.D05.1.454.CMB.2.raw
  modified_base (192)..(192): a, c, t, g, unknown or other
  modified_base (206)..(206): a, c, t, g, unknown or other
  modified_base (220)..(220): a, c, t, g, unknown or other
  modified_base (226)..(226): a, c, t, g, unknown or other
  modified_base (390)..(390): a, c, t, g, unknown or other
  modified_base (408)..(408): a, c, t, g, unknown or other
  modified_base (434)..(434): a, c, t, g, unknown or other
  modified_base (454)..(454): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagggtcctgggcccagtctgccctgactcagcctgcctcgtgtctggtctccgnggacagtcatcacntctcctgcagtgancagtgnactgttgtgttatactatgtctctgtaccaacaaccaccgagaccaacgaccccaactcatctattatgacgtcactcagtccggcctcgtacggggtttcaccgtcgtcttctcgtgtcctacgtagttcgacacgaccgtcctccgtgactattcgcggtcnccgaggtctgacggacgngtctagttatttacgtcgtcctctanattactacgaagcagcgacnccctaccgtgtacgtcgttaccggtaacggtacggaaccgtacggtacccgtaccgtacccgttaccgaaccgaccgaaccccgtaacggaccccaacccggtacttccgtaaccc

SEQ ID NO: 432160 - DNA, 529 bp, Homo sapiens
  misc_feature: GZ8MTXP02FH730.38.38.D05.1.454.CMB.2.raw
  modified_base (268)..(268): a, c, t, g, unknown or other
  modified_base (288)..(288): a, c, t, g, unknown or other
  modified_base (351)..(351): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagccccaaactcatcatttangacgtcactcatcggccctnaggggtttctactcgcttctctggctccaagtttggcaacacggcctccctgaccccatttcngggctccaggctgaggacgaggctgaattttatgctcctcatatacaggcagcagcaccccttatgtcttcggaactgggaccaagggtcaccgtcctacgtcacgcccaaggcccaaaccccactcgtcactctcgttccccgccctcctcaacgtgactcgactggacgcgggtcg

SEQ ID NO: 432161 - DNA, 656 bp, Homo sapiens
  misc_feature: GZ8MTXP02H4M8B.38.38.D05.1.454.CMB.2.raw
  modified_base (197)..(197): a, c, t, g, unknown or other
  modified_base (226)..(226): a, c, t, g, unknown or other
tcagtcgatcacgtcacgaccggtgctcgatttagtatctgatagttgggtttgggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacngtcatcaccatctcctgcacgtggaaccngcagtgactagtgtactattatactctgtcgtcgtacgtaccaacaaccaccgacgacccaaccgaccccaactactaatttattagtacggtacggtaccggtaacgtccggtaccctacgtaagtaactttaccgtaactccgtcttcttcgtcgtacctaccgtacgtcgtcgaccgtaaccgtaccggtccctaccctaccgtaccacttcctcgtacgaccctacgacggcgtacggacgggacgacggtcgtacgtaacgttactacgtacgtacgtattactaaactaactaacgtacgtacctaaccttaccttcctttacgtttacgttacgttacggtacggggacgggtacgggtaccggtacgggtaccgtaacccgtacgtaacgtaccgtacggacccgtaacggtcccgtacccg

SEQ ID NO: 432162 - DNA, 586 bp, Homo sapiens
  misc_feature: GZ8MTXP02GKQ0M.38.38.D05.1.454.CMB.2.raw
  modified_base (267)..(267): a, c, t, g, unknown or other
  modified_base (351)..(351): a, c, t, g, unknown or other
  modified_base (383)..(383): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctctgtaccaacaacacccaggcaaacgccccaaactcatcatttangacgtcactcatccggccctcgtagggtttctactcgtcttctctggctctaagtttggcaacgacgcctcctgaccctattcnggctcgagctggagacgagtctagtaattttntcgtctctcatatacgagtacagacacgtacctaccccttagtcgttaccgttacggaacgttcgggaacctaacggtccaccggttcctacgtcaacgacccgaacggccccaaaccctcgtcgtaccttaacgttcctccgtttcccccacccttcctaccgtaacgtacgtactaccgtacgtacggtacggccgggtcg

SEQ ID NO: 432163 - DNA, 586 bp, Homo sapiens
  misc_feature: GZ8MTXP02GQIKV.38.38.D05.1.454.CMB.2.raw
  modified_base (276)..(276): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactagttggtgttaataactatgtctcctagtaaccaacaaccacccaggaccaaacgcccccaaactcatcatttangacgtcactcatccgcctcgtagggtttctactcgcttctctgtctcctaagtttgacacgacgcctcctgacccctatttcgcggcctccgaggctggacggacgacggtcttagttaattttatcgcctcctacatactacgaggtcagcacgaccctaccccgttatcgtccgttacggaacgtcgggaacctaacgggtccacccgtcctacgtcacgacccgaacgaccccaaccctactcgactaccgtcctacgttccctaccccgtcctaccgaacgtcgacttcgactggaccgcggtacg

SEQ ID NO: 432164 - DNA, 650 bp, Homo sapiens
  misc_feature: GZ8MTXP02G2W5W.38.38.D05.1.454.CMB.2.raw
  modified_base (192)..(192): a, c, t, g, unknown or other
  modified_base (277)..(277): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatcctcctgcacgtggaancagtagtgactagttggtagttaataactatcgtctctaggtaaccaacaaccaccaggaccaaacgccccaaatcatctattangactcactcacgtccggcctcggtacgggtttctacgtcgtcttcctcgtcgtcctacgtaaggtttcgacctaaccgaccgtccctacccgtacgtaccccttatttccgtcggtccctacggtacggctcgggacgggacgtacggttacttaggtttaaatttcgtcgtaccttaccctagtactaacgtacgcgacacgacgtaactaccctaaccgttgtaccggttccgttaacgggacgttacggaaccgtaacgtcccaaccgtcctacgtacaccgacccgaacgtaccccaaaccgtctcgtcctacctccgtaccgttccccaccctctacgcgtctaacgtcgacgtcggacgtcggtacg

SEQ ID NO: 432165 - DNA, 490 bp, Homo sapiens
  misc_feature: GZ8MTXP02F5VKC.38.38.D05.1.454.CMB.2.raw
  modified_base (374)..(374): a, c, t, g, unknown or other
  modified_base (471)..(490): a, c, t, g, unknown or other
tcagtcgatcacgtcacgaccggtgctcgatttagtatctgatagttgggtttgggggctttgcctgggtgttgttggtaccagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgacctatttctgggctccaggctgaggacgaggctagtaattttatgctctcatatacaggcagcacgcctaccccttatgtcgttacggaactcgggaacaggtccaccgtcctacgtcacgaccccaacgcccaaaccccnctcgtccacctcttccgtttcccccaccccttcctccgtacgtcgtactaccgactacggacggtcgggccgtgggaccaaacggggcaacgatagnnnnnnnnnnnnnnnnnnnn

SEQ ID NO: 432166 - DNA, 587 bp, Homo sapiens
  misc_feature: GZ8MTXP02JLNMJ.38.38.D05.1.454.CMB.2.raw
  modified_base (386)..(386): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtagttataactatgtctctgtaccaacacaccaggacaaacgccccaaactcatcattatgacgtcactcatccgcctcgtagggtttctactcgcttctctgctctagttgcaacgacgcctcctgaccctattcgtggctcgagctgaggacgagctattaatttagtgtacctcctanatactacgagtcacgcacgtcctacccttatcgttcttacggacgtacgggaaccctaggtaccctaccgtaccgttaccgacgaccgacccgaaccgacccctaaacccctcgttaccgactacccgttccgttccggtccccctacccttccctacgaaccgttcgaaccgtaccgtacgtcggacggtccggtaccgg

SEQ ID NO: 432167 - DNA, 552 bp, Homo sapiens
  misc_feature: GZ8MTXP02FNC58.38.38.D05.1.454.CMB.2.raw
  modified_base (269)..(269): a, c, t, g, unknown or other
  modified_base (496)..(496): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctcctggtaaccaacaacacccaggacaaacgccccaaatcatcatttangacgtcactcatccggcctcgtagggtttctactcgtcttctctggcctcaaggtttggacaacgacgcctcctgacccctatttcgtggcctcaggctggacggacgaggtctagtaattttatgcctctcatatacgagcagacagtcccacccttatcgttcgtacggaactacggggacctaagggtcccaccgtcctacgcacgcccaacggcccaaacccnctcgctacgttcctcgttaccccacctctcaacgtcactcgactcgacgtcggacg

SEQ ID NO: 432168 - DNA, 567 bp, Homo sapiens
  misc_feature: GZ8MTXP02IY4XF.38.38.D05.1.454.CMB.2.raw
  modified_base (346)..(346): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgactattggtgttataactatgtctctgtaccaacacacccagaccaaagccccaaatcatcatttatgactcactcatccggccctacgtgggtttcactcgcttctcgtgctcctaagtttcggcaacgacggacctcctgaccctntttcgtggcctcaggctggagacgagtctgtaatttagtcgactctcatactacagcacgcacgcctaccccgttatcgtaccgtttacggaacgttgggaacccagggttacccaccgtcctacgtcacgacccaacgcccaacccactacgtcctactcccttacgttccccgcccttccgtaccgtaacgtcgtaacttcgactacgacggacggtcg

SEQ ID NO: 432169 - DNA, 753 bp, Homo sapiens
  misc_feature: GZ8MTXP02HO4I4.38.38.D05.1.454.CMB.2.raw
  modified_base (401)..(401): a, c, t, g, unknown or other
tcagtcgatcacgtcacgaccggtgctcgatttagtatctgatagttgggtttgggggctttgcctgggctctgttgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcttggtaccaacaacacccaggcaaacgccccaaatcatcatttatgacgtcactcactccggccctcgaggggtttcactcgctttctctggctccgtaagtttgacaacacggcctcctgacctactttcgtcgggcctccaggtcctgacgggacgacggcttagttaaatttttntacgtcctccgtactaattactaacgacggacgtaacgacctacgtacccttaacccccgtttaagttccggttaacccgtttaccggggtaaaaccgttacgggggtaaaccctaaaaccggggtttcccgtaaacccccggtttacccgttaaaccggttacccgaaacccggtaacccccgaaaaccgggtacccccaaaacccccgtacgttacccggttaccctaacccttcccgttacccggtttaccccccggtacccccttcccgttaacccgtaacccggttaaccggtaaaccgttcccggtaaacgttcggtaaccggggcccgggttaacgtaccggggg

SEQ ID NO: 432170 - DNA, 530 bp, Homo sapiens
  misc_feature: GZ8MTXP02F4HUR.38.38.D05.1.454.CMB.2.raw
  modified_base (190)..(190): a, c, t, g, unknown or other
  modified_base (218)..(218): a, c, t, g, unknown or other
  modified_base (234)..(234): a, c, t, g, unknown or other
  modified_base (237)..(237): a, c, t, g, unknown or other
  modified_base (266)..(266): a, c, t, g, unknown or other
  modified_base (286)..(286): a, c, t, g, unknown or other
  modified_base (464)..(464): a, c, t, g, unknown or other
  modified_base (477)..(477): a, c, t, g, unknown or other
tcagtcgatcacgtcacgaccggtgctcgatttagtatctgatagttgggtttggggctttgcctgggctctgctgctcctcaccctcctcactcaggggcacagggtcctgggcccagtctgccctgactcagcctgcctccgtgtctgggtctcctggacagtcgatcaccatctcctgcactggaancagtagtgacattggtggttaataactntgtctcctgtaccaanacncccaggcaaagccccaaatcatcatttangaacgtcactcatcggcctnagggtttctactcgcttctctgcttcctaagtttggcaacaccgcctccctgacccctatttcgcgggctccgaggctgacggacaggcttgtaattttatcgcttcctcataatacagcagcagccaccctagtcgtccttcggaactcgggaccaagggtcaccgtctacgtcacnccaagccaacccnctcgtcacttcgtacttcccaccctcacaacgtcgactcactcgacgtcggcg

SEQ ID NO: 432171 - DNA, 800 bp, Homo sapiens
  misc_feature: GZ8MTXP02JZ68J.38.38.D05.1.454.CMB.2.raw
  modified_base (189)..(189): a, c, t, g, unknown or other
  modified_base (271)..(271): a, c, t, g, unknown or other
tcagtcgatcacgtcacgaccggtgctcgatttagtatctgatagttgggtttggggctttgcctgggctctgctgctcctcaccctcctcactcagggcacgagggtcctgggcccagtctgccctgactcagcctgcctcgtgtctgggtctcctggacagtcgatcaccatctcctgcactggaancagcagtgactattggtacttataaccatgtctccgtagtaccaagatccaccagaccaacggacccccaaatcataattangacgtcagtagtcggcctgtagggtttctgtactcgcttcgtcgaggtcctaccgaaacgttctacgggaccaaaccgtacccggtcccttaccccccgtacgtaaccctagttcccgttcggttccggggtccttcccgggtaagggtttacggaacgggaaacggtcgggtaccgttaggtaaaccctttaatttaacggtttcgcccgggttacccttacaaccgtagtacggggtaaaacgttcgggtaaacgggggttacgggggtttttaccgggaacgggggttaaaccggggaaaccgttaaacgggtaccgggtaaccccggttacccgggttaaagggttcccgaaacgggttacccccgaaaaggggtccccgttaccccgggtccccccgttcgggttaccctaaacccgtcccggttttaacccggtccccccgtaaacccctttccgtacccgttaccggtaacgtactcccgtaacgttcggaccggtccggccgtacgggacgaaacccgggg

SEQ ID NO: 432172 - DNA, 544 bp, Homo sapiens
  misc_feature: GZ8MTXP02GG839.38.38.D05.1.454.CMB.2.raw
  modified_base (344)..(344): a, c, t, g, unknown or other
  modified_base (386)..(386): a, c, t, g, unknown or other
  modified_base (395)..(395): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtgttataactatgtctctgtaccaacaacacccaggacaaacgccccaaatcatcattatgacgtcaactcatcggcctgtagggtttctactcgcttctctgctcaagtttggcaacacgcctcctgaccctatttcnggctccgaggctgagacgaggtctagtaattttatcgctctnatactacgnggtacacgcaacgtcctaccccgttaatcgtcgttacggaacgtcggaccagggtcctaccgtcctaacgtcacgtaccccaaggaccccaaccccgatcgtcactctacgttcccacctctcaacgtgctacgacgtcgacgcggtac

SEQ ID NO: 432173 - DNA, 517 bp, Homo sapiens
  misc_feature: GZ8MTXP02FHLP0.38.38.D05.1.454.CMB.2.raw
  modified_base (348)..(348): a, c, t, g, unknown or other
  modified_base (499)..(499): a, c, t, g, unknown or other
tcagtcgatcacgtcacgaccggtgctcgatttagtatctgatagttgggtttgggggctttgcctgggctctgctgctcctcaccctcctcactcagggcacagggtcctggggcccagtctgccctgactcagcctgcctccgtgtctgggtctcctggacagtcgatcaccatctcctgcactggaagcagtagtgacattggtggttataactatgtctctgtaccaacacacccaggcaaacgccccaaactcatcatttatgacgtcactcatcggcctcaggggtttctactcgcttctctggctccaagtttggcaacacggcctcctgaccccatttcnggctccaggctgagacgagctgaatttatgctctcatatacaggcagcagcaccccttatgtctcggactgggaccaaggtcacccgtcctacgtcacgcccaacggccaaaccccactcgtctactctcgttcccgccctcctcaacgtnactacgactgacgcggcg

SEQ ID NO: 432174 - DNA, 588 bp, Homo sapiens
  misc_feature: GZ8MTXP02HMD26.38.38.D05.1.454.CMB.2.raw
  modified_base (190)..(190): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaancagtagtgacattggtggttataactatgtctctgtaccaacaacacccaggacaaagccccaaatcatcattatgacgtcactcatcgcctcgagggtttctactcgtcttctctggtcctcctaagtttggcaaacgaccggccctccctgacccctagtttctcgggctccaggctggaggcgaggctagtaattttatgtcctcctctatactacgaggcagcacgcctacccccttatccgttacgttaccggtacgtacgggtaccgaacgggttccaacccgttcctacgtcgaaccgacccgaacggccccaaaacccctctcgtaccaccgtccttccgttccccgtcccctcctaccaaccgtcgactacgactcgacggtcggtccg

SEQ ID NO: 432175 - DNA, 721 bp, Homo sapiens
  misc_feature: GZ8MTXP02HDOUH.38.38.D05.1.454.CMB.2.raw
  modified_base (289)..(289): a, c, t, g, unknown or other
  modified_base (308)..(308): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacagttggtactattataactctgtctcgtagtaaccaacacaccagccaacgaccccaactctattattatgacggtccgatccgcctanagtaatttcatcgtcttcnctcggcctacaagtcgtacggaccaaccgaccgtcccctccgtacgaaccctactcctcgtacggtaccctaccgacgggtcgtacggaacgggacgacgtctagtaacttacgacgtgacttagttacctaaataataaacgaacgtcctaaccttaccttacccgttctttacggttacgtttaaacgggttccggggaacggggtacccgggttaaccgggacggggttacccgtaaacccggttacggtaaaccggttccgaaacccggtaccgtaacgggccccgttacccgggtcccccgttacgggtacccttaccgttaccccgtttccccgggttacccccgtaccccttcccggtaaccgtacggtacgtacccgttcggtaccgtacggaccgggtccgggg

SEQ ID NO: 432176 - DNA, 713 bp, Homo sapiens
  misc_feature: GZ8MTXP02GJNI2.38.38.D05.1.454.CMB.2.raw
  modified_base (273)..(273): a, c, t, g, unknown or other
  modified_base (451)..(451): a, c, t, g, unknown or other
tcagtcgatcacgtcacgaccggtgctcgatttagtatctgatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaagcagtagtgacattgggtggttaataactatgtctctggtaaccaaacaacacccaggacaaacgccccaaactcatcatttanagacgtcactcatcggccctgtaggggtttctactcgtcttctctggctaccgtaagtttcggacaaacaccggcctccctgaccccgtattttccgtggggcctccgtaggacgttgggagggaaccggtaagggtaccttaggtaaaattttttaagtttcgaccttaccccttanaacgttaataaaccgaggggaccacggaccaacgtaccctaaaccccctttagttacggtttccgttaaacgggtaaaccgttgggggaaacccgtaaacgggttacccaaccccggttaccctaacgttaccgaaacggacccccaaagggtaccccaaaacccccgtacttacggtaccaacccttccgtccgtttcccccgacccccgttccctacgaaccgttacggacttaccgaacgtcggtaccggagggtcccg

SEQ ID NO: 432177 - DNA, 589 bp, Homo sapiens
  misc_feature: GZ8MTXP01DZOWO.25.27.C05.1.454.CMB.2.raw
  modified_base (350)..(350): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccggtcagtcagacgattagagctggttggcctggtatcagaagaaacagggaaacgccctcaactcctgatctataaggcatactaactttaaaagtgtgtcccatcaagatcagcgcagtgatcgtagggacngaattctactctcacgatcgacagcctgcagcctagatgtatttgactaacttattacgtagaccctaaactaccttaagttaaacttactttttacaacttttaccgtaaccgtttttccgggcccctttcgggggaaccctaagttcccggttagggtaatttaacgtaccaaacccggttaaacttggttacgggcttacggaacctaaccccttacttccgttcgttccgtttcc

SEQ ID NO: 432178 - DNA, 558 bp, Homo sapiens
  misc_feature: GZ8MTXP01CM7BZ.25.27.C05.1.454.CMB.2.raw
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcaagaaagaaaccagggaaacgcccctacaaactcctagatactaataaggcaatactaaactttaaaaagtggtacgtacccatacaaagattcagccgcagtggatcgtagggacaagaattctctctcacatcgacagcctgcagcctgatgtatttgactaacttatactcgacctaaactactaataaactcttttacatttaccgactttccggacccttgggacctaagtcgttaggtacttacgtactaacccgaacgttgttcggtaactcgtcaactacttctcgttctttcc

SEQ ID NO: 432179 - DNA, 575 bp, Homo sapiens
  misc_feature: GZ8MTXP01DH9O5.25.27.C05.1.454.CMB.2.raw
  modified_base (279)..(279): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccacctgtctgcatctgttggagaccgagtcaccatgacttgccgggcagtcagacgtattagtagcgttggttggcctggtatcaagaaagaaaccgagggaaacncccctacaaactcctgatactataaggcaattacttaaactttaaaaaggtggtacgtacccatacaagtattcaggccgacaggtggatcgtaagggacaagtaatttctctctacaaccgtatacgacacgcctgcagcctagtatgtatttgacttaacttattactacgactaaataacttaagttaacttacttttcagtttacctactttccggcctacgggaccctaagtcgttagattacgaacctaacgacgttggttacggctgaactccattctcttctttaacc

SEQ ID NO: 432180 - DNA, 525 bp, Homo sapiens
  misc_feature: GZ8MTXP01DOJG6.25.27.C05.1.454.CMB.2.raw
  modified_base (486)..(486): a, c, t, g, unknown or other
  modified_base (505)..(505): a, c, t, g, unknown or other
  modified_base (514)..(514): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccacctgtctgcatctgttggagaccgagtcaccatgacttggccggcagtcagacgtattagtagctggttggcctggtatcaagaagaaaccagggaaacgcccctcaaactcctagatactataaggcatactaactttaaaagtggtacgtacccatacaagtattcgagccggcagtggatcgtagggacaagaattctctctcacatacgacagcctgcagcctagattgtatttgactaacttattactaggacctaaatacttaataattacttttcatttctacgtttccgccctggctaatcgngattactacacgacttggngctagcacnttctgttcttc

SEQ ID NO: 432181 - DNA, 655 bp, Homo sapiens
  misc_feature: GZ8MTXP01AX8WZ.25.27.C05.1.454.CMB.2.raw
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtcctccttccacctgtctgcatctgttggagaccgagtcaccatgacttgccggccagtcagacgtattagtagctgggtggcctggtatcaagaacgaaaccgagggaaacgcccctacaacctcctagatctaagtaacggcaattacttaaacgtttaaaaaaggtcggttacgtacccctaataccaaaggtacttacgaacggcccgggacagggttaggagttccggtaagggggaactaaggtaaactttccttctctaccaccaatccgaacacgccctggacacgcctaggattcggttattttgaccttaaactttactttacgacgtaaccctaaactaacttaaagttaaactttacctttttacacgttttaccctaaccgttttcccgggacccgttcgggaccctaagttccggttaggtaacttacgtaccctaaacgacgttggttcggctgccaaccttgttcttcttctcg

SEQ ID NO: 432182 - DNA, 556 bp, Homo sapiens
  misc_feature: GZ8MTXP01BMCGC.25.27.C05.1.454.CMB.2.raw
  modified_base (285)..(285): a, c, t, g, unknown or other
  modified_base (413)..(413): a, c, t, g, unknown or other
  modified_base (542)..(542): a, c, t, g, unknown or other
tcagactgtacagtcacgaccggtgctcgatttagacgcgatcgaagggtttgggggagtcagacccagtcaggacacagcatggacatgagggtcccgctcagctcctggggctcctgctgctctggctcccaggtgtcaaatgtgacatccagatgacccagtctccttccaccctgtctgcatctgttggagaccgagtcaccatgacttggccgggccagtcagacgtattagagcttggttggcctggtatcaagaagaaaccgagggaaacgcccctanaactcctgatctataaggcatcttaaacgtttaaaagtggtacgtcccagtcaaagtattcagtccgcagtggatcgtagggacaagaattctctctcacatcacagctgcagcctagattgattttnactaattattacgtgacctaaatactaagttaacttcttttcacgtttctacgtttccggaccttgggaccctaagtccggttgtaacttacgtacaaaccgttagttggttacggcttcgcaaccttnttcttcgttcctcg

SEQ ID NO: 432183 - DNA, 714 bp, Homo sapiens
  misc_feature: GZ8MTXP01C7IDB.25.27.C05.1.454.CMB.2.raw
  modified_base (286)..(286): a, c, t, g, unknown or other
tcagactgtacagtcacgaccggtgctcgatttagacgcgatcgaaggggtttggggggagtcagacccagtcaggacacagcatggacatgagggtccccgctcagctcctggggctcctgctgctctggctccaggtgtcaaatgtgacatccagatgacccagtctccttccacctgtctgcatctgttggagaccgagtcaccatgacgttcgccgggaccagtcagacgtatagtagcgttggtggcctggtatacgaaggaaacgaaacgagggaaaccnccctacaacctccagatactagtaagcatacttaaacgttaaaaggtggtacctacccaagttacaaagacttacgaacggaccggtactaagggtttggggaaacttccgggttaaagggggaaaccctaagggttaaacttttccgtaaccttaccggtaacccaaaccttagtaccccgggaaactacggaccccttggaactaacgtcccgtaggtactttacggtacgtttttaaacgaaaccttaactttaactaccggtaacgtaaaccctaaacgttaacttaaacgttaacgtttacctttactacggtttaccttaccggtttacccgggccgtacgggtaactaacgggtcgttagtaacttaacgtaaccgtaacgttagttcggttacgtctacgctactcgttctcgttcgttc

SEQ ID NO: 432184 - DNA, 620 bp, Homo sapiens
  misc_feature: GZ8MTXP01AFSQM.25.27.C05.1.454.CMB.2.raw
  modified_base (193)..(193): a, c, t, g, unknown or other
  modified_base (284)..(284): a, c, t, g, unknown or other
  modified_base (416)..(416): a, c, t, g, unknown or other
  modified_base (439)..(439): a, c, t, g, unknown or other
  modified_base (443)..(443): a, c, t, g, unknown or other
  modified_base (588)..(588): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatcgaccagtctccttccacctgtctgcatctgtganaccgagtcaccagtgtacttggccggcagtcagtacgtattagtagctgggtcgccgtggtatacgaaggaaacgaaaccgagggaaaccnccctacgaaacctcctagaatactactaagacaactttacttaaacgtttaaaacgtcggtactaccctaagtacaagtacttcgacggtccggactaggtcggtaagtcgtaacggggactaagtattccnctactcacacttacgacacgccngacncgtactagtatcgttattactaataacttatacgacggtaacctaagtaactaacttacttacttctaccgttccgttaccgtccggtaccgtcggtactcgtacgttagtacttacgtaccgtaacgttcgttcggttccgtcncgtaacccgtctacgttcctcgttccgttccg

SEQ ID NO: 432185 - DNA, 524 bp, Homo sapiens
  misc_feature: GZ8MTXP02GFJ7V.25.27.C05.1.454.CMB.2.raw
tcagactgtacagtcacgaccggtgctcgatttagacgcgatcgaagggtttgggggagtcagacccagtcaggacacagcatggacatgagggtcccgctcagctcctggggctcctgctgctctggctcccaggtgtcaaatgtgacatccagatgacccagtctccttccaccctgtctgcatctgttggagaccgagtcaccatgacttgccgggccagtcagacgattagagctggttggcctggtatcagaagaaaccagggaaacgcccctcaactcctgatctataaggcatctaactttaaaagtgtgtccatcaagatcagcggcagtgatctgggacagaattctctctcacatcgacagcctgcagcctgatgtatttgtactaacttattactactactaactaactaactaatacttttacttattactactttcgtcccgtcggtaccgtaacgtcgtggtatactactaaccgtaaccgtacgtggtctcgcactactctctctttcc

SEQ ID NO: 432186 - DNA, 487 bp, Homo sapiens
  misc_feature: GZ8MTXP02FW08G.25.27.C05.1.454.CMB.2.raw
  modified_base (353)..(353): a, c, t, g, unknown or other
  modified_base (386)..(386): a, c, t, g, unknown or other
  modified_base (407)..(407): a, c, t, g, unknown or other
  modified_base (413)..(413): a, c, t, g, unknown or other
  modified_base (427)..(427): a, c, t, g, unknown or other
  modified_base (478)..(478): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaaagaaaccagggaaagcccctcaactcctgatctataaggcatctaactttaaaagtgtagtccatcaagattcagccgcagtgatctgggacngaattctctctcacatcgacagcctgcagctgntgattttgactaattatactnaccaanactataatactttnattctacttcgcctgggacatcgtgatatacaacgtactgtagctcgcacntctctctac

SEQ ID NO: 432187 - DNA, 547 bp, Homo sapiens
  misc_feature: GZ8MTXP02I5AUF.25.27.C05.1.454.CMB.2.raw
  modified_base (350)..(350): a, c, t, g, unknown or other
  modified_base (355)..(355): a, c, t, g, unknown or other
tcagactgtacagtcacgaccggtgctcgatttagacgcgatcgaagggtttgggggagtcagacccagtccaggacacagccatggacatgagggtccccgctcagctcctggggctcctgcctgtctctggctcccaggtgtcaaatgtgacatccagatgacccagtctccttccacccgtgtctgcatctgttggagaccgagtcacctatgacttgccggcagtcagacgattagtagctggttggcctggtatcagaagaaaccagggaacgccccgtacaactcctgatcataggcatactaacttaaaagtgtgtcccatacaagatcagcgcagtgatcgnggacngtattctctctcacatcgacagcctgcagcctgatcgtatttgactaactttagttacttgacctaactacttataacgttactttttacactttctacgtttcgaccgtgggtaccctagtcggtaggacttactaccgaaaccgtaactggtacggtcgtcgacgtacctagtcctacgttcctttaccg

SEQ ID NO: 432188 - DNA, 511 bp, Homo sapiens
  misc_feature: GZ8MTXP02F02WX.25.27.C05.1.454.CMB.2.raw
  modified_base (421)..(421): a, c, t, g, unknown or other
  modified_base (479)..(479): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaagaaaccagggaaagcccctcaactcctgatctataaggcatctaactttaaaagtggtgtcccatcaagattcagccggcagtgatctagggacagaattctctctcacatcgacagccctgcagcctgatgtattttgactaattattactgacccaaanacttaataagtactttttcaatttctactttcggccctgggacctagtcgtaggatancaacgactgtgctgcacctatctcgtctttac

SEQ ID NO: 432189 - DNA, 509 bp, Homo sapiens
  misc_feature: GZ8MTXP02FRZ3B.25.27.C05.1.454.CMB.2.raw
  modified_base (364)..(364): a, c, t, g, unknown or other
  modified_base (442)..(442): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggtggctggtatcagaagaaacagggaaagcccctcaactcctgatctataaggcatctaactttaaaaagtggtagtcccagtcaaagattcagccggcagtggatctgggacagaattctntctcacatcgacagccctgcagcctagatgtattttgacaaactttattactgaccaactactaataataccttttanattctactttcgcctgggacctatcgtaggtactatacaacgactgtagctgcaccatctgtcttac

SEQ ID NO: 432190 - DNA, 571 bp, Homo sapiens
  misc_feature: GZ8MTXP02H298D.25.27.C05.1.454.CMB.2.raw
  modified_base (276)..(276): a, c, t, g, unknown or other
  modified_base (290)..(290): a, c, t, g, unknown or other
tcagactgtacagtcacgaccggtgctcgatttagacgcgatcgaagggtttggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaagaaaccaggggaaaccnccctacaactctanatactagtagcatactaaactttaaaagtgtactaccatacgagtatcgaggccgacgagtggatcgtagggaacagtaacttctctctaccaccagtacgacacgctcgcgacgcctagtatagtatttagtactaacttaattaacttacgtacctaactaactaattaattaactttactacttactacttaccgtccgtacggtacgtacgtacgtacggtacgtactaacaaccgtaacgtacgtacgtcgtcgacacctactacttcgttacttc

SEQ ID NO: 432191 - DNA, 577 bp, Homo sapiens
  misc_feature: GZ8MTXP02JBLWL.25.27.C05.1.454.CMB.2.raw
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggcagtcagacgattagtagctggttggcctggtatcagaagaaaccagggaaacgcccctacaactcctgatctataaggcatactaactttaaaagtggttcgtcccatacaaagtattcgagccggcaggtggatcgtagggacagtaacttctactctcacatcgacagcctgcagcctgatgtatttgactaattattactagacctaaactactattaaacttactttttcaactttctaaccgtttccggcccgtaggggtaaccctagttcggtaggtacttaactaccgtaaacccgtaacgtcgttacggccttcggacctacccatttccgttacgttacctttaccg

SEQ ID NO: 432192 - DNA, 533 bp, Homo sapiens
  misc_feature: GZ8MTXP02HAP3C.25.27.C05.1.454.CMB.2.raw
  modified_base (351)..(351): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccacctgtctgcatctgttggagaccgagtcaccatgacttgccgggcagtcagacgattagtagctggttggcctggtatcagaagaaaccagggaaacgcccctacaactcctgatctataaggcatctaactttaaaagtggtagtccatcaagatcagcgcagtgatcgtggacngaattctctctcacatcgacagcctgcagcctgactgtatttgactaactttatactgacctaatactagttaaatacttttacaatttcaactttccggaccttgggaccctagtccggtaggaacttacgtactaaccgtaacttggtcggcttcggacctaccatcttcgttactttcc

SEQ ID NO: 432193 - DNA, 520 bp, Homo sapiens
  misc_feature: GZ8MTXP02ILVC7.25.27.C05.1.454.CMB.2.raw
  modified_base (489)..(489): a, c, t, g, unknown or other
tcagactgtacagtcacgaccggtgctcgatttagacgcgatcgaagggtttggggagtcagacccagtcaggacacagcatggacatgagggtccccgctcagctcctggggctcctgctgctctggctcccaggtgtcaaatgtgacatccagatgacccagtctccttccacctgtctgcatctgttggagaccgagtcaccatgacttgccgggccagtcagacgattagagctggttggcctggtatcagaaagaaaccagggaaagcccctacaactcctgatctataaggcatactactttaaaaagtggtagtcccatcaaagattacagccgcagtggatcgtgggacagtaattctctctcacatcgacagcctgcagccctagactagtattttgactaaactttattaacctgacctaaacacttaataaacgtacttttacatttctactttcgacctggactagtcgtagactanacaacgactgtgctgcaccatctagtcttac

SEQ ID NO: 432194 - DNA, 542 bp, Homo sapiens
  misc_feature: GZ8MTXP02I4TQJ.25.27.C05.1.454.CMB.2.raw
  modified_base (423)..(423): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggcagtcagacgattagtagctggttggcctggtatcagaagaaaccagggaaagcccctacaactcctagatctataaggcaatctaactttaaaaagtggtacgtcccatcaagtattcgagccggcagtggatcgtgggacagaattctctctcacatcgacagcctgcagcctagatgtattttgacttaattattactanacctaacacttaataatactttttacatttactactttccggacccttagggacctacgtcgtaggtacttacaccgaaccgtaacttcgtacggcttgactacctatctcgttcttac

SEQ ID NO: 432195 - DNA, 550 bp, Homo sapiens
  misc_feature: GZ8MTXP02JY3XC.25.27.C05.1.454.CMB.2.raw
  modified_base (541)..(541): a, c, t, g, unknown or other
tcagactgtacagtcacgaccggtgctcgatttagacgcgatcgaagggtttggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaagaaaccagggaaacgcccctcaactcctgatctataaggcatctaactttaaaagtggtgtcccatcaaagattcagccggcaggtggatcgtaggggacaggaattctctctccacatccgacacgcctgcagcctgatgtattttgacttaaactttattacctagacccaaatacttaattaaacttactttttacaatttcctaccttttccgggccccttagggacccattccggtaggtactactacgaaaccgtactggtcggcttcgacacctntctcgtctc

SEQ ID NO: 432196 - DNA, 494 bp, Homo sapiens
  misc_feature: GZ8MTXP02IRRLX.25.27.C05.1.454.CMB.2.raw
  modified_base (327)..(327): a, c, t, g, unknown or other
  modified_base (351)..(351): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggcagtcagacgattagtagctggttggcctggtatcagaagaaaccagggaaagcccctcaactcctgatctataaggcatctactttaaaagtggtgtccatcaagnttcagccgcagtggatctgggacngaattctctctcacatcgacagcctgcagcctgatgattttgactaacttattactgaccaacactataatacttttcatttcactttcggcctggacctatcgtggatactacacgaactgtagctgcaccatcctgtcttc

SEQ ID NO: 432197 - DNA, 579 bp, Homo sapiens
  misc_feature: GZ8MTXP02HZ50W.25.27.C05.1.454.CMB.2.raw
  modified_base (194)..(194): a, c, t, g, unknown or other
  modified_base (277)..(277): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctccaggtgtcaaatgtgacatccagatgacccagtctccttccacctgtctgcatctgttgganaccgagtcacatgacttgccgggccagtcagacgattagtagctggttggcctggtatcagaagaaaccagggaaagcccctnaactcctagatctataaggcatactaactttaaaaagtggtagtacccatcaaagattcagccggcagtggatcgtaggggacagaattctcttctcaccatcgacagccctgcagcctagatgtaattttcgctaaactttattaacctgacctaaactactaagttaaagtactttttacatttacctaactttccggtccctaggggaccctaagtccgttaggacttaactacctaaaaccgaacttacgtacgggtcccttaggaccaccctaagttccttacgtttcctttaaccc

SEQ ID NO: 432198 - DNA, 581 bp, Homo sapiens
  misc_feature: GZ8MTXP02I137U.25.27.C05.1.454.CMB.2.raw
  modified_base (356)..(356): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaagaaaccagggaaagcccctcaaactcctgatctataaggcatactaactttaaaagtggtgtcccatcaaagatcagccgcagtggatctgggacngaattctctctcacatcgacagcctgcagccctgatgtattttgactaactttattactgaccctaaataccttaattaaagtaacttttttcaattttcctaacgttttccggcccttaggggaaccctaagttcggttaggtaacttaactacctaaaaccgtaaaccttggtaccgggtcttacggacctaaccccgatttcccgtttacgtttacctttac

SEQ ID NO: 432199 - DNA, 543 bp, Homo sapiens
  misc_feature: GZ8MTXP02FTS8L.25.27.C05.1.454.CMB.2.raw
  modified_base (277)..(277): a, c, t, g, unknown or other
  modified_base (359)..(359): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagcgtggttggcctggtatcagaagaaaccgagggaaacncccctacaactcctgatctataaggcatctaactttaaaagtgtgtcccatcaaagattcagccgcagtggatcgtgggacngaattctctctcacatcgacagcctgcagcctgattgtattttgactaactttattactgacccaactaacttaattaacgttacctttttcaatttcctaacgtttccggccctggggaccctagtcgtaggaactacgtacaaacccgtactggtcggctcgacctaccatctcgtctttac

SEQ ID NO: 432200 - DNA, 520 bp, Homo sapiens
  misc_feature: GZ8MTXP02HV5AX.25.27.C05.1.454.CMB.2.raw
  modified_base (195)..(195): a, c, t, g, unknown or other
  modified_base (340)..(340): a, c, t, g, unknown or other
  modified_base (346)..(346): a, c, t, g, unknown or other
  modified_base (416)..(416): a, c, t, g, unknown or other
  modified_base (513)..(513): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccacctgtctgcatctgttgganaccgagtcaccatgacttgccgggccagtcagacgattagagctggttgcctggtatcagaagaaaccaggaaagcccctcaactcctgatctataagcatactaactttaaaagtgtgtaccatcaagatcagccgcagtgatntggganagtaattctctctcacatcgacagcctgcagccttagatgtatttgactaacttaattactagacctaanacttataaacgtactttttcaatttcctactttccggaccttgggacctagtcgttagatacttacgaaccgaactgtaggcttgactaccatcgtnttacttc

SEQ ID NO: 432201 - DNA, 542 bp, Homo sapiens
  misc_feature: GZ8MTXP02JE81N.25.27.C05.1.454.CMB.2.raw
  modified_base (361)..(361): a, c, t, g, unknown or other
  modified_base (366)..(366): a, c, t, g, unknown or other
  modified_base (375)..(375): a, c, t, g, unknown or other
  modified_base (394)..(394): a, c, t, g, unknown or other
  modified_base (396)..(396): a, c, t, g, unknown or other
  modified_base (398)..(398): a, c, t, g, unknown or other
  modified_base (400)..(400): a, c, t, g, unknown or other
  modified_base (402)..(402): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctccaggtgtcaaatgtgacatccagatgacccagtctccttccacctgtctgcatctgttggagaccgagtcaccatgacttgccgggcagtcagacgattagtagctggttggcctggtatcgagaaagaaaccagggtaaacgcccctacaactcctagatctagtaacggcatactaacgtttaaaaagtggtactacccatacaaagtatacagccgcagtgatcgnggacngtaatctcnctcaccgatcgatacgccncncncncntatatatatactactatactactactactactaataacttacttacttacttacttacgttaccgtaccgtacgtacgtacgtacgtagtactactaactaacgtacgtacgtacgtcgtacgactactactctctactc

SEQ ID NO: 432202 - DNA, 589 bp, Homo sapiens
  misc_feature: GZ8MTXP02HKCSS.25.27.C05.1.454.CMB.2.raw
  modified_base (281)..(281): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaagaaaccagggaaacgcccctnaactcctgatctataaggcatactaactttaaaaagtggtagtcccatcaaagattcagccggcagtggatcgtgggacagaattctctctcacatcgacagcctgcagcctgatgtaatttgactaacttattactgtacctaaacactaattaaatactttttacaatttcctaacgttttccggacccttacggggtaaccctaagttcccggttaggtaaacttaacgttaccaaaacccggtaaacgttcggtacggggtccttacggacctaacccaatttcccttacgtttccctttaacc

SEQ ID NO: 432203 - DNA, 521 bp, Homo sapiens
  misc_feature: GZ8MTXP02FQOGM.25.27.C05.1.454.CMB.2.raw
  modified_base (367)..(367): a, c, t, g, unknown or other
  modified_base (501)..(501): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagttaccatgacttgccgggccagtcagacgattagagctggttggcctggtatcagaagaaaccagggaaagccccctacaactcctgatctaataaggcaatactaactttaaaaaagtggtagtcccatcaaagattcagcgcagtggatctgggacagattcnctctcacatcgacagcctgcagcctgatgtattttgactaaacttattactcaccaaactactaattaaatacttttacattctactttcgccttagggacctagtcgtaggatactacaaaccgactgcggcngtttcactatctgtctctac

SEQ ID NO: 432204 - DNA, 594 bp, Homo sapiens
  misc_feature: GZ8MTXP02JI8ZV.25.27.C05.1.454.CMB.2.raw
  modified_base (381)..(381): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggcagtcagacgattagtagctggtggcctggtatcagaagaaaccagggaacgcccctacaactcctgatctataaggcatactaactttaaaagtggtcgtaccatacaagatcagccggcagtgatcgtagggacagaattctactctcaccatcgaacngacctgcagcctgatgtacttttgactaactttattactacgaccctaactaacctaattaaagttacctttttactaactttccgtaaccttttccgggtaccccgtaggggtaacccctagttaccggtaggtaacttactaccgtaaaccgtaaaccgttggtacgggtccttacggacctacccgtaatttccttacgttcctttaccc

SEQ ID NO: 432205 - DNA, 505 bp, Homo sapiens
  misc_feature: GZ8MTXP02FJ66K.25.27.C05.1.454.CMB.2.raw
  modified_base (341)..(341): a, c, t, g, unknown or other
  modified_base (360)..(360): a, c, t, g, unknown or other
  modified_base (372)..(372): a, c, t, g, unknown or other
  modified_base (403)..(403): a, c, t, g, unknown or other
  modified_base (415)..(415): a, c, t, g, unknown or other
tcagactgtacagtcacgaccggtgctcgatttagacgcgatcgaaggggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaagaaaccaggggaaaagccccctcaaactcctgatctataaggcatctaactttaaaaagtggtgtcccatcaagattcancggcagtggatctgggacngaatctactctnacatcgacagccctgcagcctgatgattttnactattatacanacaatactaataattactttacacttacgtcttcgccgtggactagtcgtagactactacaacgtactgtgctcgacactagtctctctc

SEQ ID NO: 432206 - DNA, 501 bp, Homo sapiens
  misc_feature: GZ8MTXP02FOWT6.25.27.C05.1.454.CMB.2.raw
  modified_base (414)..(414): a, c, t, g, unknown or other
  modified_base (437)..(437): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaagaaaccagggaaagcccctcaactcctgatctataaggcatctactttaaaagtggtgtcccatcaagattcagccggcagtggatcgtgggacagaattctctctcacatcgacagcctgcagcctgattgtattttgactaactttattacngaccaacactaataatacttttnattctacttcggcctgggaccatcgtgactatcaaccgaactgtagctgcaccatctgtcttac

SEQ ID NO: 432207 - DNA, 519 bp, Homo sapiens
  misc_feature: GZ8MTXP02HNTMJ.25.27.C05.1.454.CMB.2.raw
  modified_base (471)..(471): a, c, t, g, unknown or other
  modified_base (513)..(513): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaagaaaccagggaaacgcccctcaactcctgatctatagcatctaatttaaaagtgtagtccatcaagtattcagccggcagtggatcgtgggacagtaacttctctctcacatcgacagccctgcagcctagattgtatttgactaacttattactgacctaactacttataaacttacttttacatttctacgtttccgcccgtggacctntcggtgtactactacaaccgtactgtcgctgactaccatctnttcttc

SEQ ID NO: 432208 - DNA, 640 bp, Homo sapiens
  misc_feature: GZ8MTXP02HH4Z8.25.27.C05.1.454.CMB.2.raw
  modified_base (277)..(277): a, c, t, g, unknown or other
  modified_base (370)..(370): a, c, t, g, unknown or other
  modified_base (446)..(446): a, c, t, g, unknown or other
  modified_base (574)..(574): a, c, t, g, unknown or other
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtcaaatgtgacatccagatgacccagtctccttccacctgtctgcatctgtggagacgagtcacatgactgccgggcagtcagacgattagtagcgtggttggcctggtatcaaggaaacgaaaccgaggggtaaacncccctacaacgtcctagatcgtaataaggctaatactaaattttaaaaaggtcggtacgtacccaataccaaagtacttcgaaggccccgganagtcggtaatcggtagggaacaggttaacttctacgttactccctaaaccacttcggacctacgcctaacgctaancccgtaggtatacggttacttttacgaaccttaactttaaataccgttacgtaacctaaactaacttaacttaaactttccttttataactttactacggtttcccgaccgtagtaccgacttacggngtaacttacgaaccgtaaccgtattcggcgtaacgtcactaaccctgttccgtactttcttacccg

SEQ ID NO: 432209 - DNA, 701 bp, Homo sapiens
  misc_feature: GZ8MTXP02ID9SI.25.27.C05.1.454.CMB.2.raw
tcagactgtacagtcacgaccggtgctcgatttagacgcgatcgaagggtttgggggagtcagacccagtcaggacacagcatggacatgagggtccccgctcagctcctggggctcctgctgctctggctcccaggtgtacaaatgtgacatccagatcgaccagtctccttccacctgtctgctatcgtgttggacgaccgagtcaccatcgacttcggccggcagccagacgtattagtagcgttgggttcggcctggtatagaagaaacgaaaccgaaggaaccgcccctacacctctagactactagtaagctacttaaccttaaaagtttaaaaggtcggtaccgtacctaatacaaagtcttacgaggcccgacgtagtggtacgtggtacggaactagttacttaccttcctccttaccaactaccgtacgaaaccgcgtaccctgccacgtcctagtacttgtttaactttacgaaacctttaactttaactttaacccgtaacgtaaccttaaactaactttaaacgtttaaaccttttaccttttactacctttccgtttaaaccggtttcccggtaccgttacggggtaaccttacgtacggttacgtaaacttaaccgtaaaccgtaaccgttaacgttcggtcgtaactcggtaaccctacttacgttctttacgttacctttaccg

SEQ ID NO: 432210 - DNA, 527 bp, Homo sapiens
  misc_feature: GZ8MTXP01DC6EE.8.53.E09.1.454.CMB.2.raw
  modified_base (222)..(222): a, c, t, g, unknown or other
  modified_base (274)..(274): a, c, t, g, unknown or other
  modified_base (389)..(389): a, c, t, g, unknown or other
tcagctcgcgtgtccacgaccggtgctcgatttagagagagtgtgttgggtttgggggcacaagaggcagcactcaggacaatctccagcatggcctggtctcctctcctcctcactctcctcgctcactgcacagggtcctgggcccagtctgtactgacgcagccgccctcagtatcgtggggccccagggcagaggtctccatctcctgcacgtgggancagaaccagcagtcggggcaggttatgatgttcatgaccgcagtcaggcacngccccagactctcattaatgaataacaacaatccggccctagaggggtctctcgaccgattctctgaccctcaagtctggctacttctcgcctcctgtcatatctgtctcgaggngaggatgaggctagatttattactcgtccaactcctatacgaacaactagcctgagttaagtttcggcgttggttcggcgggtacgggaccttaaggttcgaacccgtctaacggtcacgccctaaggccgttccccg

SEQ ID NO: 432211 - DNA, 658 bp, Homo sapiens
  misc_feature: GZ8MTXP01DPGT8.8.53.E09.1.454.CMB.2.raw
  modified_base (228)..(228): a, c, t, g, unknown or other
  modified_base (390)..(390): a, c, t, g, unknown or other
  modified_base (431)..(431): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagcccgccctcagtatcgtcggggccccagggcaggagggtctccatctcctgcacgtgggancagaaccagcagtcgggggctaggttatgatgtcagtcggaccgcaggttccaggcacacgcccccagacctcctacattaaatgaataaacaacaaactccggaccctcgaggggtctcgtcgaccgtattctctcgaccctaccaagtctggctacttcncgtcctccctgtctatactctggtctacgagggtgaggtangaggtacttaggtaatttacttacgtcgtaccctacttaccctagtacgaaaccaaacgtcgtaccgttaggtaaggtttaacgtttcgggccgtttcgggttccgggggaccggggtaaccgggggttaacccgttaagggtttcccggtaaccccggttacccgttaacccggttaccggaacccggttaccccggtaaaccgggttcccgtttcccccccgggg

SEQ ID NO: 432212 - DNA, 590 bp, Homo sapiens
  misc_feature: GZ8MTXP01AV6S2.8.53.E09.1.454.CMB.2.raw
  modified_base (220)..(220): a, c, t, g, unknown or other
  modified_base (383)..(383): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatctggggccccaggcagaggtctcatctcctgcactgggancagaaccagcagtcgggggcaggttatgatgtcatggtaccgcaggtccaggcacacgcccccagacctcctacaattaatgaataaaccaactaaagtccggaccctgacgggggtctcgtacgaccgtattcctctgaccctaccaagtctggctacttcncgcctccctgtcatatctggtctaccgagggtgaggatcggagtctagtatttacgttactgccctactccctatacgaacaacctagtccttaggtagttaagtttcgggcgtttgggttccgggtcggggtacgggttaacccgttaaggtttccgaacccgttccgtaacgttaccgacggaccccgaacggttccgtccccgg

SEQ ID NO: 432213 - DNA, 536 bp, Homo sapiens
  misc_feature: GZ8MTXP01A4VHS.8.53.E09.1.454.CMB.2.raw
  modified_base (220)..(220): a, c, t, g, unknown or other
  modified_base (448)..(448): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccaggcagagggtctccatctctgcactgggancagaaccagcagtcgggggcaggttatgatgttcatcggtaccgccaggttccaggcacacgcccccagacctcctacattaatgaataacaacaatccggccctcgaggggtctctcgaccgtattctctcgaccctaccaagtctgctacttctcgcctcctgtcatatctgtctcgagggtgaggatgaggctgtatttattaccttccactcctatcgacaacngtcctgtagttattggtcttggttcgggcggtaccgggtacttaaggttcgaccgtcctacgtcacgcccgaggtccttccgtccccg

SEQ ID NO: 432214 - DNA, 609 bp, Homo sapiens
  misc_feature: GZ8MTXP01ELCK2.8.53.E09.1.454.CMB.2.raw
  modified_base (174)..(174): a, c, t, g, unknown or other
  modified_base (225)..(225): a, c, t, g, unknown or other
  modified_base (245)..(245): a, c, t, g, unknown or other
  modified_base (407)..(407): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctnagtatcgtcggggccccagggcaggaggtctccatctcctgcacgtgggancagaaccagcagtcgggggntaggttatgatgttcatggaccgcaggtccaggcacacgccccagacctcctctaattaatagaactaaacaaactaagtccggccctcgaggggtctcgtaccgaccgtattcctctcgtaccctacaagtctggcctaccttctcgcctccctgtctatntcgtggtccttacgagggttgaggagtgaggtctaggttaatttagttactcgaccctacttcctaataggaaacctaacacgtaccttaggtaagtttaagtttcgggcgttcgggttcggggccgggtaccgggttaaccgttaacggtttcgaacccgttccgtaacgtccgacgaccccgtaagggcccttccccggg

SEQ ID NO: 432215 - DNA, 592 bp, Homo sapiens
  misc_feature: GZ8MTXP01CLQGE.8.53.E09.1.454.CMB.2.raw
  modified_base (224)..(224): a, c, t, g, unknown or other
  modified_base (304)..(304): a, c, t, g, unknown or other
  modified_base (409)..(409): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtggggccccagggcagagggtctccatctcctgcacgtgggancagaaccagcagtcggggcaggttatgatgttcatggtaccgcaggttccaggcacagcccccagacctcctacattaanagaataacaacaatccggcctcgaggggtctctcgaccgtattctctcgccctacaagtctgctactctcgcctccgtgtcatatctggtctacgagggtgaggntgagtctagtatttacttactcgacctacttccctatacgaacctaacgtacggtcctaggtacgttaagtttcggttcgttcgggtttccggggacgggaccggggttaaccgttaacggttaccggtaacccgttcccgtttaaccgacgtaccggacccgtaacggttcccgtccccggg

SEQ ID NO: 432216 - DNA, 623 bp, Homo sapiens
  misc_feature: GZ8MTXP01CS1HI.8.53.E09.1.454.CMB.2.raw
  modified_base (177)..(177): a, c, t, g, unknown or other
  modified_base (227)..(227): a, c, t, g, unknown or other
  modified_base (254)..(254): a, c, t, g, unknown or other
  modified_base (313)..(313): a, c, t, g, unknown or other
  modified_base (315)..(315): a, c, t, g, unknown or other
  modified_base (396)..(396): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacgagggtcctgggcccagtctgtactgacgcacgcccgccctnagtatcgtcggggccccaggcaggaggtcctcatcctcctgcacgtggancaagaaccagcagcggggataggttangattgtcagtcggtaccgcgaggttccaggcacacgcccccagcctcctacatttaaananaactaacaacacgtccgacctacgacggtctacgtaccgacctattctctccgtaccctactaacgtctcgtcctacttcncgtccctccgtgtactatcgtcgtcgtcgtcggtagggtagaggatggaggtcttagttaactttaacttcgtcgaccctacttactaacgtacgaaccaacgtacgtacgtaggtaagtttaacgtttcggttcgttcgggttccggggtacgggaccggttaacgttacggttaccggtaacccgttaccgtaacgacgtaccgaccgtaacgttcccgtccccg

SEQ ID NO: 432217 - DNA, 595 bp, Homo sapiens
  misc_feature: GZ8MTXP01AW5UP.8.53.E09.1.454.CMB.2.raw
  modified_base (222)..(222): a, c, t, g, unknown or other
  modified_base (241)..(241): a, c, t, g, unknown or other
  modified_base (248)..(248): a, c, t, g, unknown or other
  modified_base (263)..(263): a, c, t, g, unknown or other
  modified_base (370)..(370): a, c, t, g, unknown or other
  modified_base (430)..(430): a, c, t, g, unknown or other
tcagctcgcgtgtccacgaccggtgctcgatttagagagagtgtgttgggtttgggggcacaagaggcagcactcaggacaatctccagcatggcctggtctcctctcctcctcactctcctcgctcactgcacagggtcctgggcccagtctgtactgacgcagccgccctcagtatcgtggggccccaggcagagggtctccatctcctgcacgtgggancagaaccagcagtcggggnaggttangatgtcatggtaccncaggttccaggcaccacgcccccagacctcctacatttaaatgaataaacgaacaatccggaccctcgaggggtctctacgaccgtattctctcgccttccaagtcnggtcacttctcgccctccctgtcagttactcgtggtctaccgagggtgaggattgaggtntagtagttactacgtcgacctactaccgtagtacgaacacgtacgtacgtaggtaagttaacgtttcggttcggttcgggttccgggccgggtaccgggttaccgttaacggttccgtaacccgtaccgtaacggtacgaccggaccgtaacggttcccgtcccg

SEQ ID NO: 432218 - DNA, 443 bp, Homo sapiens
  misc_feature: GZ8MTXP01AT11A.8.53.E09.1.454.CMB.2.raw
  modified_base (434)..(443): a, c, t, g, unknown or other
tcagctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattatactgccactcctatgacacagcctgagtatttggctggttcggcggcgggaccaagttcgaccgtctagtcagcccaaggcctgccccctggtcactctcgttccccgccctcctcgacacgcgagctgacgcgggctggcaagggcgcgataggnnnnnnnnnn

SEQ ID NO: 432219 - DNA, 604 bp, Homo sapiens
  misc_feature: GZ8MTXP01BWH0X.8.53.E09.1.454.CMB.2.raw
  modified_base (219)..(219): a, c, t, g, unknown or other
  modified_base (299)..(299): a, c, t, g, unknown or other
  modified_base (396)..(396): a, c, t, g, unknown or other
tcagctcgcgtgtccacgaccggtgctcgatttagagagagtgtgttgggtttgggggcacaagaggcagcactcaggacaatctccagcatggcctggtctcctctcctcctcactctcctcgctcactgcacgagggtcctgggcccagtctgtactgacgcagccgcctcagtatctggggccccaggcagaggtctccatctcctgcacgtggancagaaccagcagtcggggctaggttatgatgttcagtcggaccgcaggtccaggcacacgccccagacctcctcattaangactaaacaacaacgttccggccctgacggggtctcgtacgaccgtattcgtctcgacctaccgaagtctggcctacttctcgtccctcctgtcatntcgtgtctcgaggtgagagtgagtactgtattacgttactcgacacctcctatacgaactaacgacgtaccttaggtaagttaagtttcgggttccgttgggttccgggacgggtccgggttaacccgttaaggttacccgggtaaccccgttccgttaaccggtccggaaccggttaccccgaaacgggttccccgttaaccccggg

SEQ ID NO: 432220 - DNA, 515 bp, Homo sapiens
  misc_feature: GZ8MTXP01DS58A.8.53.E09.1.454.CMB.2.raw
  modified_base (226)..(226): a, c, t, g, unknown or other
  modified_base (374)..(374): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatcgtggggccccagggcaggagggtctccatctcctgcacgtgggancagaaccagcagtcggggcaggttatgatgttcatggtaccgcaggttccaggcacacgcccccagacctcctcattaatgataacaacaatccggcctcgaggggtctcgtcgaccgtattctctgccctcaagtctggctacttcncgcctccctgtcatatctggtctcgagggtgagatgagctgattattactgaccactcctatcgaacactagcctgagttaattggcttggttcggcggtcgggacttagttcgcctctaacgtcacgcaacgttctcccg

SEQ ID NO: 432221 - DNA, 662 bp, Homo sapiens
  misc_feature: GZ8MTXP01DRKK5.8.53.E09.1.454.CMB.2.raw
  modified_base (227)..(227): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatcgtcggggccccagggcaggagggtctccatctcctgcacgtgggancagaaccagcagtcggggactaggtatgatgtctagtcggtaccgccgtacggtccgaggcaccaccgaccccacgacctcctactaattaatagaactaaacaaacaactccgggggggggcctacgacgggtctctccgaccgtattctctcgtaccctacctaacgtcgtacggtcctacttccgtcgtccctcccgttcgtactaatctcgtcggttcgtaccggtagggtaggaggagtaggtaggtacgttagtaagtttaacttacgtctacctacctacctactacgaaaccaacgtacgtaccgtagtaggttaagtttcgggttcggttcgggttccgggaccggggtaccgggttaaccgttaacggttaccgtaacccgtaccgtaaccgtaccgaccggacccgaacggttcccgtccccgg

SEQ ID NO: 432222 - DNA, 453 bp, Homo sapiens
  misc_feature: GZ8MTXP01AG6NK.8.53.E09.1.454.CMB.2.raw
  modified_base (406)..(406): a, c, t, g, unknown or other
  modified_base (447)..(453): a, c, t, g, unknown or other
tcagctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgccctccctggtcatatctggtctccagggtgaggatgaggctgattatactgccactcctatgacaacagcctgagttatttggcttggttccggcggcgggacctaaggttccgaccgtcctacgtccagccccaaggcctcgccccctggtcactctcgttccccaccctccncgacacgcgagctgaggcgggctgggacaaggcgcagtagnnnnnnn

SEQ ID NO: 432223 - DNA, 550 bp, Homo sapiens
  misc_feature: GZ8MTXP01ELMI6.8.53.E09.1.454.CMB.2.raw
  modified_base (224)..(224): a, c, t, g, unknown or other
  modified_base (267)..(267): a, c, t, g, unknown or other
  modified_base (302)..(302): a, c, t, g, unknown or other
  modified_base (393)..(393): a, c, t, g, unknown or other
  modified_base (409)..(409): a, c, t, g, unknown or other
  modified_base (417)..(417): a, c, t, g, unknown or other
  modified_base (421)..(421): a, c, t, g, unknown or other
  modified_base (428)..(428): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatcgtggggccccagggcagaggtctccatctcctgcacgtgggancagaaccagcagtcgggggcaggttatgatgttcagtggaccncaggtccaggcacagcccccagcctcctcattaangataaacaacaagtccggacccttcagggggtctctcgaccgtattctctgccctcaagtctggctacttctcgcccttcccgtgtctatntctggtctcgagggtnaggatggnggtntgtattnttacgtcgcctactccatcgaacaactacgtcctgtattaagtttgcgttacggttcgggcgggtccgggacgttaaggttcgtaacccgtctaacggtcacggacctaacgggctccccgg

SEQ ID NO: 432224 - DNA, 542 bp, Homo sapiens
  misc_feature: GZ8MTXP01EWV5F.8.53.E09.1.454.CMB.2.raw
  modified_base (221)..(221): a, c, t, g, unknown or other
tcagctcgcgtgtccacgaccggtgctcgatttagagagagtgtgttgggtttgggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggancagaaccagcatcgggggcaggttatgatgttcatggtaccgcaggttccaggcacacgcccccagactcctcattaatgaataaacaacaatccggcccttcgaggggtctctcgaccgtattctctcgaccctccaagtctggcacttctcgcctcctgtcatatcgtgtctcgagggtgaggatgagctgagttattactgccactcctagtcgaactaacgagccttgagttaagtttggcgttggtttcggcgggtcgggaccgttaacggttcgaacccgtcctaacgtccacgcccgtaacggccgttccccgg

SEQ ID NO: 432225 - DNA, 585 bp, Homo sapiens
  misc_feature: GZ8MTXP01EEVQ5.8.53.E09.1.454.CMB.2.raw
  modified_base (232)..(232): a, c, t, g, unknown or other
  modified_base (275)..(275): a, c, t, g, unknown or other
  modified_base (307)..(307): a, c, t, g, unknown or other
  modified_base (317)..(317): a, c, t, g, unknown or other
  modified_base (432)..(432): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatccgtcgggggcccccagggcaggagggtcctccatcctcctgcacgtgggancagaaccagcagtcggggctaggttatgatgtcagtggtaccncgtaggtccaggcacacgcccccagcctcctntaattaatanaataaacaacaacgtcgcctcgagggtctcgtcgaccgtattctcgtcaccctacaagtctcggactcttctcgtccttcccgtgtctatatcgtggtctacggagggtgagtangagtcttagtatttacttactcctactctatgtaacaaacgcgtacctgtaacgttgtttcgggcttgggttccggcgggtacggtaacccgttaaggtttccgacccgttcctacgtcgaccggacccgttaggtcccgttcccgtcccccg

SEQ ID NO: 432226 - DNA, 569 bp, Homo sapiens
  misc_feature: GZ8MTXP01CERPP.8.53.E09.1.454.CMB.2.raw
  modified_base (222)..(222): a, c, t, g, unknown or other
  modified_base (300)..(300): a, c, t, g, unknown or other
  modified_base (347)..(347): a, c, t, g, unknown or other
  modified_base (376)..(376): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctctgcactgggancagaaccagcagcggggctaggttatgatgtcatggaccgctaggtccaggcacacgcccccagacctcctcattaangaactaacaaacaagtccgaccttcgagggtctctcgaccgtattcnctgccctaccaagtctggacctcttcgcnccctccctgtcattctcgtgtctcgaagggtgaggtatggagtcgtagtacttacttacgttcacctactcctaagtgaaaccactagtcctgtaagttgttttggttcggttcggcgggtaccggtacggttacgttcggaccccgttaacgtacgtccgacgcccgttaacggttccgcccgttcccccgg

SEQ ID NO: 432227 - DNA, 607 bp, Homo sapiens
  misc_feature: GZ8MTXP01B6GM2.8.53.E09.1.454.CMB.2.raw
  modified_base (223)..(223): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtcggggccccagggcagaggtctccatctcctgcactgggancagaaccagcagtcggggcaggttatgatgttcagtcggtaccgccgtaggttcccaggcacgacgccccccagacctccctactaatttaaactgaaacttaaaccaaacaaacgtccggaccccttcgaacggggtctccgtacgacccgtattctctcgtaccctaccaagtctcggctacttctcgccctcctgtcattactcgtcgtctaccgagggtgaggagtcgagtctagtagttacttactcgacctacctcctatacgtaaccaacgtacgtcctaggtagttaagtttcggttcgttcggttccgggacgggtcggttaacccgttaagttccggtaacctccgtaacgtcgacgacctaacggctccccgg

SEQ ID NO: 432228 - DNA, 619 bp, Homo sapiens
  misc_feature: GZ8MTXP01D1RHN.8.53.E09.1.454.CMB.2.raw
  modified_base (225)..(225): a, c, t, g, unknown or other
  modified_base (260)..(260): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtcggggccccagggcaggaggtctccatctcctgcacgtgggancagaaccagcagtcgggggctaggttatgatgttnagtcggaccgcgtaggttccaggcacacgcccccagtacctcctactaatttaatagaacttaaacaaactaaacgtcccggaccctacggtacggggtctacgtacgaccgtattccgtctcgtaccctactaagtctcggtcctacttctcgtcccttcccgtagtactagttactcgttcggtccttacggagggttagaggtagtgagggtcttaggttaactttacttacgtcacctactcctaatcgaaacactacgtctagtagtttaagtttgggttcggttcgggcggtacgggtacttaacggttcgacccgttctacgtcgaacgcccgaggtcccttccggtccccg

SEQ ID NO: 432229 - DNA, 627 bp, Homo sapiens
  misc_feature: GZ8MTXP01BCIM2.8.53.E09.1.454.CMB.2.raw
  modified_base (224)..(224): a, c, t, g, unknown or other
  modified_base (232)..(232): a, c, t, g, unknown or other
  modified_base (243)..(243): a, c, t, g, unknown or other
  modified_base (301)..(301): a, c, t, g, unknown or other
  modified_base (440)..(440): a, c, t, g, unknown or other
  modified_base (488)..(488): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatcgtggggccccagggcagaggtctccatctcctgcacgtgggancagaaccngcagtcggggntaggtatgatgtcatggaccgctaggtccaggcacacgcccccagctcctcaattaanagactaacaacaatccggaccctcgaggggtctcgtcgaccgtattcctctcgaccctccgaagttcgtcgggcctacctttctcggtccccttcccgtggtctattactcgttcggtcctaccgtaggggtcgagggntggagtcgttagtagtttacttacttccctactcctaatcgaacaacngtcctagtagtttagttcgggtcgttgggttccgggcggggtaccgggtaaccgttaaacgggtttccggaaccccgttccgttaaccggtccgtaaccggaccccgttaaacgggtcccgttccccggtcccccccgg

SEQ ID NO: 432230 - DNA, 672 bp, Homo sapiens
  misc_feature: GZ8MTXP01BVIL0.8.53.E09.1.454.CMB.2.raw
  modified_base (223)..(223): a, c, t, g, unknown or other
  modified_base (299)..(299): a, c, t, g, unknown or other
  modified_base (305)..(305): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatctggggccccaggcagagggtctccatctcctgcacgtgggancagaaccagcagtcggggcaggttatgatgttcatggtaccgcctaggttccaggcacacgcccccagacctcctnattaangaataacaacaatcggccctgaggggtctctcgaccgtattcctctcgccctaccaagtcctgggcctacctttctcggtcccttcccgtcggttactacttacgtcgttcgggttccttacccggtagggggttgaggggattgggagggtaccttggtaacgttttaactttacttacccctacttacccttagtacggaacaaacgtacgtccttagtagtttacgtttcgggtcttcgggtttccggggcgggtaccggggtaacccgttaacgggtttccggttaacccccgggttccgttaacccggtccggttaacccgaccccggttaaaccgggtcccgttccccggttcccccccgg

SEQ ID NO: 432231 - DNA, 630 bp, Homo sapiens
  misc_feature: GZ8MTXP01DJMXB.8.53.E09.1.454.CMB.2.raw
  modified_base (227)..(227): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatcgtcggggccccagggcaggagggtctccatctcctgcacgtgggancagaaccagcagtcggggctaggttatgattgttcagtcggtaccgccgaggttccaggccacgacgccccccaagaccttcctacaatttaaatagaaactaaacaaactaaacgtccgggaccctacgacggggttctcgtacgacccgtattcctctcgtaccctactaacgtctcggctacttctcgtcctccctgtcatactcgtggtctacgagggtgaggatgaggtactagtatttagtactcgcctaactcctagtacgaaacaacgtacgtccgtaggtaacgtttaagtttcggcgtttcggggttcgggacgggtccgggttaacgttacggttaccgtaacccggttacctaacggttccgacggttacccgaacgggttccctccccgg

SEQ ID NO: 432232 - DNA, 821 bp, Homo sapiens
  misc_feature: GZ8MTXP01EMFSY.8.53.E09.1.454.CMB.2.raw
  modified_base (175)..(175): a, c, t, g, unknown or other
  modified_base (228)..(228): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgcccctnagtatcgtcggggccccagggcaggagggtcctccatctcctgcacgtgggancaagaaccagcagtcgggggctaggttatggatgttcagtcggaccgcctaggttccaggccacgaccgcccccagacctcctactatttaaatgaaactaaacaaacctaaacgttcccgggaccccttcgaagggggttccttaccgttaccggaaccccggttatttcccttcctcgggtaacccccttacccgtaacggttcccgttacgggtaccctaaccgtttttcccgtccggtccccctttcccccgtttgggttacttacgttaacttcgttcggtccgttaccccggtagggggtttaggagggtaagttcgggaacgggtttacgtttaacggttaaacgttttaacgtttaccgttaccgttaccccttaaccgttacccgttaacgtaaccgtaaacctaaccgtaccggttaccgtttagggtaacggttttaacggtttcgggttccgggtttccggggttacccggggtacccggggttaacccgggttaaacccgttacgggtttacccgttaaccccggttaccgtaacccggttacccgtacccggaacccgtaaccggttccccgtccccgg

SEQ ID NO: 432233 - DNA, 701 bp, Homo sapiens
  misc_feature: GZ8MTXP01B6BYY.8.53.E09.1.454.CMB.2.raw
  modified_base (177)..(177): a, c, t, g, unknown or other
  modified_base (228)..(228): a, c, t, g, unknown or other
  modified_base (250)..(250): a, c, t, g, unknown or other
  modified_base (258)..(258): a, c, t, g, unknown or other
  modified_base (274)..(274): a, c, t, g, unknown or other
  modified_base (315)..(315): a, c, t, g, unknown or other
  modified_base (399)..(399): a, c, t, g, unknown or other
  modified_base (569)..(569): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacgagggtcctgggcccagtctgtactgacgcacgccgccctnagtatcgtcggggccccagggcaggacggtcctcatctctgcacgtggganacagaaccagcaggtcgggggntaggttangatgtcagtcggaccnccgtaggtccaggcacaccgccccagctccctataattaanacaataaacaaacaacgtccgccctagacggggtctcgtacgaccgtattcctctcgtaccctacaagtctgggacctacttcnccgtacctccgtcgtcaactcttcgtcggttcgtaccggtaggggtacggtaggtaagtgggaacggtcgttaggtaactttaacgtttaccgtacgtacccttaaccgttacctaactacggtaaacaaaccgtacgttaccgtaggttaagtttaacggttttcgggnggtttccggggtttccggggacggggtaacccggggttaacccgttaacgggttaccccgggttaaccggttacccgtaaccggttaccggaacccggaccccgtaaacggggttcccgttaaccccccggg

SEQ ID NO: 432234 - DNA, 696 bp, Homo sapiens
  misc_feature: GZ8MTXP01BE39V.8.53.E09.1.454.CMB.2.raw
  modified_base (227)..(227): a, c, t, g, unknown or other
  modified_base (235)..(235): a, c, t, g, unknown or other
  modified_base (330)..(330): a, c, t, g, unknown or other
tcagctcgcgtgtccacgaccggtgctcgatttagagagagtgtgttggggtttgggggggcacaagaggcagcactcaggacaatctccagcatggcctggtctcctctcctcctcactctcctcgctcactgcacagggtcctgggcccagtctgtactgacgcacgccgcctcagtactcgtcggggccccagggcaggaggtcctcatctctgcacgtgggancagaaccngcgaggtcggggactaggttatgtatcgttacagtcggaccgccgtaggtccgacggcaaccgaccgaccccagtacctcctataacttaagtanaactaaacaaacacgtccggtccctacggacgggttctcgtcgaccgttattccgtctccgaccctactaacggtctcgtaccttacgttccgtcgtccccttacccgttggtacctaatttcgtccgttcggtaccgtttaccgggagggttacggtagggttacgagggtacgggtacctttaaggttacgttttaaacttacccggttaccacccttaccgttactacgtaactaaaccgactaacgtccgttagtagtttaacggttcggttcgttcggggttcggtaccggggtccgaacgttagttacccggtcccgtacgttaacccgtcgacggttacccgtaagttccccgtccccg

SEQ ID NO: 432235 - DNA, 632 bp, Homo sapiens
  misc_feature: GZ8MTXP01C3LZ9.8.53.E09.1.454.CMB.2.raw
  modified_base (177)..(177): a, c, t, g, unknown or other
  modified_base (226)..(226): a, c, t, g, unknown or other
  modified_base (254)..(254): a, c, t, g, unknown or other
  modified_base (271)..(271): a, c, t, g, unknown or other
  modified_base (303)..(303): a, c, t, g, unknown or other
  modified_base (309)..(309): a, c, t, g, unknown or other
  modified_base (449)..(449): a, c, t, g, unknown or other
  modified_base (475)..(475): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacgagggtcctgggcccagtctgtactgacgcacgccgccctnagtatcgtcggggcccagggcaggacggtctcatctctgcacgtgggancaagaaccagcagtcggggataggttangtatgtcagtcggaccncgtagtaccaggcacacgccccagacctctanaattanagaactaacaactacgccggtacctggacgggttctacgtaccgaccgtattcctctccgtacccttacgaagttccgtacgaccttactccgtcgtccctacgtgtactatcgtcgtcgttacgacggtgggtagaagngtagcgtatagttacttactcgtacncctactactactacgaacacgtctccgttagtgtttaacggttcggcggtttacgggttcggggtaccgggtaacggttaaccgttcgttacccggtaacccgttacccgtaacggtaaccgaccggttaccccgtaacggttccccgttcccccgg

SEQ ID NO: 432236 - DNA, 655 bp, Homo sapiens
  misc_feature: GZ8MTXP01BBO4S.8.53.E09.1.454.CMB.2.raw
  modified_base (225)..(225): a, c, t, g, unknown or other
  modified_base (309)..(309): a, c, t, g, unknown or other
  modified_base (318)..(318): a, c, t, g, unknown or other
  modified_base (487)..(487): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagcccgccctcagtatcgtggggccccagggcaggaggtctccatctcctgcacgtggancagaaccagcagtcggggctaggttatgattgttcagtcggtaccgccgtaggtccgaggcaccgacgcccccagacctcctanaactttaangaactaaacaacaacgtccggaccgtacgaggggtctacgtccgaccgtattccgtctacggtccctaccgtaagtcgtcgggtcctacctttcgtccggtccccttcccgtcggtactacgttacttccgtacggttccttaccgggtaagggttggaaggtgtaggnggtacgttggttaactttacgtttaaccgtcgtaccctaacctcctaacttcgaaacaacgtacgtaccgttagtagttaacgtttcggcgttcggttccgggtcgggtaacgggaccgttaggttccgtaacccgtcgtaacgtcacgccgtaacgttccgtccccg

SEQ ID NO: 432237 - DNA, 655 bp, Homo sapiens
  misc_feature: GZ8MTXP01DV7K1.8.53.E09.1.454.CMB.2.raw
  modified_base (176)..(176): a, c, t, g, unknown or other
  modified_base (232)..(232): a, c, t, g, unknown or other
  modified_base (294)..(294): a, c, t, g, unknown or other
  modified_base (308)..(308): a, c, t, g, unknown or other
  modified_base (316)..(316): a, c, t, g, unknown or other
  modified_base (365)..(365): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcacgccgccctnagttatccgtgggggcccccagggcaggagggtcctccatctcctgcacgtgggancagaaccagcagtcggggactaggttatgattgttcagtcggtaccgctaggtccaggcacncgccccagctcctnaatttaanagactaacaaccaagtccggcctcggacggggtctctcgaccgtattcnctcgccctactaagtctgggtaccctactttcctcgtccccttcctcggttactaattctcgttcggtccttaccggagggttgaggattggagtcttagtaagtttattactcgtaccctacttaccctagttacgaaacctacgtacgtccgttaggtgttaacggttttttgggttcggttccggggttaccgggaccggggtaaccgttaaaggtttcccgttaacccggttccgtaccgttccgacggaccccgaacgggtccccgttcccggtttccccccggg

SEQ ID NO: 432238 - DNA, 662 bp, Homo sapiens
  misc_feature: GZ8MTXP01CNOCT.8.53.E09.1.454.CMB.2.raw
  modified_base (228)..(228): a, c, t, g, unknown or other
  modified_base (502)..(502): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatcgtcggggccccagggcaggacgggtctccatctcctgcacgtgggancaagaaccagcagtcggggctaggttatgattgtactagtcggtaccgcgtacggtcacggacaccgaccgcccccaacgtaccttcctactaatttaaagtacgaaactaaaaccaaacgtaaacgtccggacccttacggaacggggttctcgtaccgaccgtatttctctccgacccttactaacgtcgtacggccttacgtcgtcgtccctcccgttcgtactagttactcgttcggttccgtacgtaggggtaggaggtagaggaggtnttagttactttaacgttacgtcgacccttaactcctaagtcgaaacaactcgtcgtagtagttaagtttcggcgtttcggttcgggaccgggtacggaacgttacggttccgtaacccgttaccgtccgtacgacgttacccgaaggttcccgtaacccg

SEQ ID NO: 432239 - DNA, 447 bp, Homo sapiens
  misc_feature: GZ8MTXP01E4WQI.8.53.E09.1.454.CMB.2.raw
  modified_base (300)..(300): a, c, t, g, unknown or other
  modified_base (388)..(388): a, c, t, g, unknown or other
  modified_base (393)..(393): a, c, t, g, unknown or other
  modified_base (413)..(413): a, c, t, g, unknown or other
  modified_base (432)..(447): a, c, t, g, unknown or other
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctcagggtgaggatgaggctgattattactgccactcctatgacaacngcctgagttattggctggtcggcggcggacagtcgaccgtctagtcagcccaaggctcgcccctggtcactctcgttccccgcctccncgacncgcgagcgtgacgcgggcgnggacgaaggcgacagtagnnnnnnnnnnnnnnnn

SEQ ID NO: 432240 - DNA, 666 bp, Homo sapiens
  misc_feature: GZ8MTXP01BIEFO.8.53.E09.1.454.CMB.2.raw
  modified_base (227)..(227): a, c, t, g, unknown or other
  modified_base (234)..(234): a, c, t, g, unknown or other
  modified_base (286)..(286): a, c, t, g, unknown or other
  modified_base (362)..(362): a, c, t, g, unknown or other
tcagctcgcgtgtccacgaccggtgctcgatttagagagagtgtgttggggtttgggggggcacaagaggcagcactcaggacaatctccagcatggcctggtctcctctcctcctcactctcctcgctcactgcacagggtcctgggcccagtctgtactgacgcagccgccctcagtatcgtcggggccccagggcaggagggtctccatctctgcacgtgggancagaacngcagtcggggctaggttatgatgttcagtcggccgcgtaggtccaggccacnccgccccagacctcctactaattaatacgaactaaacaactaacgtccggaccctgacggggtctcgtcgaccgtnttcctctcgtccctacgtaacgttcgtcggtactacctttctcgcccttccctggttctaacttcgtcgtaggtcgtaccggagggggtagacgggtgtcgtagggtacttagttaatttacgtttaccggtacctacccttaacctcccgttaattacggaaacctaaccgtacgttaccgtagttacgttaacggtttcggcgtttacggggttccggacgggggtaccggttaacgttaacggttccggtaaccccgttcgtccggtacgcccggacccggtaacgttcccgttcccccgg

SEQ ID NO: 432241 - DNA, 805 bp, Homo sapiens
  misc_feature: GZ8MTXP01DBUE7.8.53.E09.1.454.CMB.2.raw
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcacgccgccctcagttactccgtcggggccccagggcaggtacgggtcctccattcctccgtgcctacggtgggaacacgtaacgaaccacggtcgaggtcgggggactagggttatggattgttactaacggttcggacccgccgtaacgggttccaggtccaaccgcccgaccccccgaaagtcccttaccctactaaattttaaacgaacgtaaaactaaaccgaaaccttaacggtccccggtacccgttacggaacgggggttcctaccggttacccggtaaacccttcgtttccttccgtccgtaaccccctaccggtaagttccgtcggtaccctttaccgttccgtccgtccccgttcgttcgaccttatttgccgtttcggccgttacgggtaggggtagaggtagtacggaggttacgttagtttacgtttacttacgtccgtaccttaccttacgtaacgttacgaaacctaaccgttcggtaaccgttcggtttaaaggtttcgtttcgggttcggttaacccggtttcggggcccgggtaaaaccggttcgtttaccggttacccgttaaccggttaccgtaaccggttaccaaccgggttcccggttaacgccccggtttcccccgg

SEQ ID NO: 432242 - DNA, 586 bp, Homo sapiens
  misc_feature: GZ8MTXP01BN23N.8.53.E09.1.454.CMB.2.raw
  modified_base (175)..(175): a, c, t, g, unknown or other
  modified_base (223)..(223): a, c, t, g, unknown or other
  modified_base (242)..(242): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctnagtatcgtggggccccagggcagaggtctccatctcctgcactgggancagaaccagcatcgggggntaggttatgatgtcatggtaccgctaggttccaggcacagcccccagactcctacattaatgtaataaacaaacaatccggaccctgacggggtctcgtcgaccgtattctacctgaccctaccaaggtctcggactaccttctcgaccctccctaggtctatatcgtggtctaccgtagggtgaggtatcgaggactggtaagtttattactcgtcctactcctagtacgaactaacacgtccgtagtagttaagtttcggttcttcgggttcggcgggtacgggaccttaggttcggtaaccctcgttaaccgtcgaccgccgtaacggttcctaaccccgg

SEQ ID NO: 432243 - DNA, 442 bp, Homo sapiens
  misc_feature: GZ8MTXP02GBMCY.8.53.E09.1.454.CMB.2.raw
  modified_base (437)..(442): a, c, t, g, unknown or other
tcagctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctcaggtgaggatgaggctgattattactgccactcctatgacaacagcctgagtatttggcttggttcggcggcgggacctaagttcgaccgtcctacgtcagcccaaggcctcgccccctggtccactctcgttccccaccctcctcgacacgcgagctgacgcgggctggcaaggcgcatagnnnnnn

SEQ ID NO: 432244 - DNA, 430 bp, Homo sapiens
  misc_feature: GZ8MTXP02ILJJ3.8.53.E09.1.454.CMB.2.raw
  modified_base (428)..(430): a, c, t, g, unknown or other
tcagctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctcaggtgaggatgaggctgattattactgccactcctatgacaacagcctgagtatttggctgtcggcggcgggacagttcgaccgtcctacgtcagcccaaggctcgccccctggtccactctcgttccccaccctcctcgacacgcgagctgagcgggctggcaaggcgcatgnnn

SEQ ID NO: 432245 - DNA, 434 bp, Homo sapiens
  misc_feature: GZ8MTXP02HE37Q.8.53.E09.1.454.CMB.2.raw
  modified_base (429)..(434): a, c, t, g, unknown or other
tcagctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattatactgccactcctatgacaacagcctgagtatttggctgttcggcggcggaccaagtcgaccgtcctacgtcagcccaaggcctcgccccctggcactctcgttcccgccctcctcgacacgcgagctgacgcgggctggcaaggcgcatgnnnnnn

SEQ ID NO: 432246 - DNA, 558 bp, Homo sapiens
  misc_feature: GZ8MTXP02I2TK5.8.53.E09.1.454.CMB.2.raw
  modified_base (323)..(323): a, c, t, g, unknown or other
  modified_base (397)..(397): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgcccccagactcctcattaatgataacaacaatcggccctnaggggtctctcgaccgattctctgcctcagtctggcacttctgcctcctgtcatatctgtctccgagggtgagntgaggtctgtattactttacttccacttccctatcgtaacaacgtacgtcctagtagttactttcgggctttggttccgggcgggtaccggggtaacctaaacggtttcgaacccggttccgtacggtcgacggccccaaagggccgtaccgtccccccgg

SEQ ID NO: 432247 - DNA, 609 bp, Homo sapiens
  misc_feature: GZ8MTXP02IUS7M.8.53.E09.1.454.CMB.2.raw
  modified_base (226)..(226): a, c, t, g, unknown or other
  modified_base (398)..(398): a, c, t, g, unknown or other
  modified_base (454)..(454): a, c, t, g, unknown or other
tcagctcgcgtgtccacgaccggtgctcgatttagagagagtgtgttgggtttgggggcacaaggaggcagcactcaggacaatctccagcatggcctggtctcctctcctcctcactctcctcgctcactgcacgagggtcctgggcccagtctgtactgacgcagccgccctcagtatcgtcggggccccagggcaggaggtctccatctccagcacgtgggancaagaaccagcagtcggggctaggttatgattgtcattcggtaccgcgtacggttccaggcacgaccgccccagacctcctcaattaatgaataaacaaactaagtccggccctacgacggggtactctacgaccgtattctctcgtccctacacgttctaggcctacttcncgtccctccgtgtcatatcgtgtctcgtaggtgaggatgagtctagtattattacncgtacctactcctagtcgaacaacgtacgtaccgtagtacgtttagttcggtcgtttcgggttcggggaccgggtaccggggtaaaccgtaagtttccggaacccggtttccgtaaccggttacgaaccggcccgtaaacggtccttcccccggg

SEQ ID NO: 432248 - DNA, 622 bp, Homo sapiens
  misc_feature: GZ8MTXP02IUUC5.8.53.E09.1.454.CMB.2.raw
  modified_base (228)..(228): a, c, t, g, unknown or other
  modified_base (309)..(309): a, c, t, g, unknown or other
  modified_base (390)..(390): a, c, t, g, unknown or other
tcagctcgcgtgtccacgaccggtgctcgatttagagagagtgtgttgggtttggggggcacaaggaggcagcactcaggacaatctccagcatggcctggtctcctctcctcctcactcctcctcgctcactgcacagggtcctgggcccagtctgtactgacgcagccgccctcagtatcgtcggggccccagggcaggagggtctccatctccagcacgtgggancaagaaccagcagtcggggctaggttatgattgttcattggtaccgctaggttccaggcacaccgcccccagacctcctanattaatgaataacaactaatccggcccctagaggggtctcgtcgaccgtattcctctcgccttacagtctcggctacttcngtccctcctgtcattactcgtcgttcctacgaggggtgacggtagtgaggtctaggtatttaattaccgtcgacctaccttactattacgaacaaacgacgtacctaggtaacgtttagtttggtcgttcgggtttaccgggcgggtaccggggtaaccttaacgggtttacgtaacccggttacccgtaaccggttaccaccggtacccaaacgggtcccgtttcccccgg

SEQ ID NO: 432249 - DNA, 548 bp, Homo sapiens
  misc_feature: GZ8MTXP02GS57H.8.53.E09.1.454.CMB.2.raw
  modified_base (221)..(221): a, c, t, g, unknown or other
  modified_base (474)..(474): a, c, t, g, unknown or other
tcagctcgcgtgtccacgaccggtgctcgatttagagagagtgtgttgggtttgggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggancagaaccagcagtcggggcaggttatgatgttcagttggtaccgccaggtccaggcacacgcccccagacctcctctaattaatgaataaacaacaaagtccggaccctgacggggtctcgtcgaccgtatttctctcgcccttacagtctcggcctacttcgtcgtcccttcccgtggtcctattactcgtcggtcctccgaggggtgaaggatgaggtctgtatttattactcctacttcctatcgacaancgtctagtagtattcggcttggtcggcggcggtactacgtcgaccgtctacgtcacgccgacggctcgtccccg

SEQ ID NO: 432250 - DNA, 672 bp, Homo sapiens
  misc_feature: GZ8MTXP02G080U.8.53.E09.1.454.CMB.2.raw
  modified_base (222)..(222): a, c, t, g, unknown or other
  modified_base (248)..(248): a, c, t, g, unknown or other
  modified_base (295)..(295): a, c, t, g, unknown or other
  modified_base (302)..(302): a, c, t, g, unknown or other
  modified_base (366)..(366): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggancagaaccagcagtcggggcaggttangatgttcattggtaccgcaggttccaggcacagcccccagactcctnaattaangaataacaacaatccggccctgaggggtctctcgaccgattctctgcctcagtctggcacttcncgcctccctgtcatatctggtctccgagggtgaggataggaggtctaggtaatttacgtttaacgtcggtaccctaaccttaccccttaaagttaccgggtaaacccaaaacgtaaccggtacccccgtttagggtaaacgtttttaaaggtttttacggggttttacgggtttaccgggggttccgggggaaccgggggttaacccgttaaaacgggtttaccggtaaccccggttaacccgttaacccggtaccgttaacggtaacccccggaaacggtccccgttacccggttccccccccgg

SEQ ID NO: 432251 - DNA, 517 bp, Homo sapiens
  misc_feature: GZ8MTXP02ICQRH.8.53.E09.1.454.CMB.2.raw
  modified_base (220)..(220): a, c, t, g, unknown or other
  modified_base (245)..(245): a, c, t, g, unknown or other
  modified_base (299)..(299): a, c, t, g, unknown or other
  modified_base (371)..(371): a, c, t, g, unknown or other
  modified_base (409)..(409): a, c, t, g, unknown or other
  modified_base (447)..(447): a, c, t, g, unknown or other
tcagctcgcgtgtccacgaccggtgctcgatttagagagagtgtgttgggtttgggggcacaagaggcagcactcaggacaatctccagcatggcctggtctcctctcctcctcactctcctcgctcactgcacagggtcctgggcccagtctgtactgacgcagccgccctcagtatctggggccccagggcagaggtctccatctcctgcactgggancagaaccagcatcggggcaggttangatgtcattggtaccgccaggttccaggcacacgcccccagactcctcattaangaataacaacaaatcggccctcgacggggtctctcgaccgtattctctgtccctccagtctggcctacttcncgccttccctcgtcatatctggtcctcgagggtgaggntgagctgtattattactgccacttccgtatgaacaacngcctgtattagttggctgttcggcggtcggactaagttcgaaccgtctacgtcacgtcccgaagctcccg

SEQ ID NO: 432252 - DNA, 521 bp, Homo sapiens
  misc_feature: GZ8MTXP02IKHPW.8.53.E09.1.454.CMB.2.raw
  modified_base (223)..(223): a, c, t, g, unknown or other
  modified_base (301)..(301): a, c, t, g, unknown or other
  modified_base (365)..(365): a, c, t, g, unknown or other
  modified_base (418)..(418): a, c, t, g, unknown or other
  modified_base (441)..(441): a, c, t, g, unknown or other
tcagctcgcgtgtccacgaccggtgctcgatttagagagagtgtgttgggtttgggggcacaagaggcagcactcaggacaatctccagcatggcctggtctcctctcctcctcactctcctcgctcactgcacagggtcctgggcccagtctgtactgacgcagccgccctcagtatctggggccccaggggcaggagggtctccatctcctgcactgggancagaccagcagtcggggcaggttatgatgttcattggtaccgcaggttccaggcacacgccccagactcctcattaangaataacaacatccgccctgagggtctctcgaccgattctctcgcctccagtctggctacttcngtcctcctgtcattatcgtgtctcgagggtgaggatgaggctgtattattacngacctactcctatacgacaaacngctagtagttattggctcggttcggcggtccgggactaacgttcgaaccgtccgtaacgtcacgtcccgaacggctcccg

SEQ ID NO: 432253 - DNA, 519 bp, Homo sapiens
  misc_feature: GZ8MTXP02HWP9Q.8.53.E09.1.454.CMB.2.raw
  modified_base (174)..(174): a, c, t, g, unknown or other
  modified_base (252)..(252): a, c, t, g, unknown or other
  modified_base (331)..(331): a, c, t, g, unknown or other
  modified_base (344)..(344): a, c, t, g, unknown or other
  modified_base (384)..(384): a, c, t, g, unknown or other
  modified_base (421)..(421): a, c, t, g, unknown or other
  modified_base (429)..(429): a, c, t, g, unknown or other
  modified_base (434)..(434): a, c, t, g, unknown or other
  modified_base (516)..(516): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctnagtatcgtggggccccagggcaggacggtctccatctcctgcacgtgggagcagaaccagcagtcggggctaggttangatgtcattggaccgcgtagtcaggcacacgccccagactcacataatgaataacaactacgtacgcctgacgggtctntcgaccgtattcnctcgcctcagtctgactcgttctcgccctacctcgtcatntctcgtctcgaggtgagagtgaggctagtattatacntcctactntaacnacacgctctagtagtcgtcgtcgtcggtacggcggacgtacgtacgtacgtaaccgtcgtacgacgaccgaccgtacgtccnccg

SEQ ID NO: 432254 - DNA, 529 bp, Homo sapiens
  misc_feature: GZ8MTXP02I4RYW.8.53.E09.1.454.CMB.2.raw
  modified_base (222)..(222): a, c, t, g, unknown or other
  modified_base (390)..(390): a, c, t, g, unknown or other
  modified_base (397)..(397): a, c, t, g, unknown or other
  modified_base (442)..(442): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggancagaaccagcatcggggcaggttatgatgttcattggtaccgccaggttccaggcacacgcccccagactcctcattaatgataacaacaatcgccctcgaggggtctctcgaccgattctctcgccctcagtctggctacttctgcctcctgtcatatctgtctcgnggtgagntgagctgtatttagttactcgcctaacctcctatacgaacaaacncgtacctagtagtttagtttggcttcggttcggcgggacggaacctagttacgaaccgtcctacgtccacgacccgaaggcctcccg

SEQ ID NO: 432255 - DNA, 557 bp, Homo sapiens
  misc_feature: GZ8MTXP02JIHYL.8.53.E09.1.454.CMB.2.raw
  modified_base (223)..(223): a, c, t, g, unknown or other
  modified_base (249)..(249): a, c, t, g, unknown or other
  modified_base (423)..(423): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtggggccccagggcagagggtctccatctcctgcactgggancagaaccagcagtcggggcaggttangatgttcattggtaccgcaggttccaggcacacgcccccagactcctcaattaatgaataaacaaacaactcggccctcgaggggtctctacgaccgtattctactcgcctccagttctggcctacttcctgccctccctgtcattactcgtgtccgtaccgaggggtgaggtntggagctggtattatacgtgcctactcctatacgacaacagtcctagtacgttactttggcgttcgggttccggcgggacggtaaccgtaagtccggtaaccgtccgtacgtacacgccaacggcttaccccgg

SEQ ID NO: 432256 - DNA, 566 bp, Homo sapiens
  misc_feature: GZ8MTXP02INU6I.8.53.E09.1.454.CMB.2.raw
  modified_base (224)..(224): a, c, t, g, unknown or other
  modified_base (304)..(304): a, c, t, g, unknown or other
  modified_base (440)..(440): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtggggccccagggcaggagggtctccatctcctgcactgggancagaaccagcagtcggggcaggttatgatgtcattggtaccgcaggttccaggcacacgcccccagacctcctcattaangaataaacaacaatccggccctacgaggggtctctcgaccgtattctctcgccttacagtctggctacttctcgcccttccctgtcattactcgtggtcctcgagggtgacggatgaggtctgtaatttattacgngacctactcctatcgaacaacgacgcctagacgttagttcggcgttcggttcgggccgggtacggtaaccgtaaggttcgaacccgttcgtaaccggtcaacggtcccgtaacggtccgtccccgg

SEQ ID NO: 432257 - DNA, 478 bp, Homo sapiens
  misc_feature: GZ8MTXP02GK14F.8.53.E09.1.454.CMB.2.raw
  modified_base (286)..(286): a, c, t, g, unknown or other
  modified_base (462)..(478): a, c, t, g, unknown or other
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctcgcctccctggtcatatctggtctccgagggtgaggatgaggctgattattacngccactcctatcgaacaacagcctagtagttatttggctggttcgggcggcgggaacctaggttccgacccgtcctacgtcacgcccaaggcctccgccccctggtccacctctcgttccccaccctcctccgacgacgcgagctgacggcgggcgtggcgaacggcgacagtagnnnnnnnnnnnnnnnnn

SEQ ID NO: 432258 - DNA, 620 bp, Homo sapiens
  misc_feature: GZ8MTXP02FVF71.8.53.E09.1.454.CMB.2.raw
  modified_base (506)..(506): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcagtcggggcaggttatgatgttcattggtaccgcctaggttccaggcacacgcccccagacctccataatatgaactaaacaacaacgtccgtaccctaggacgggtcctcgtaccgaccgtacttctcgtcgtcccttacctagttcgtacggtcctaccgttctcggtcccttcccgtggtctaattactcgtcggttcccgtaccggtagggttagaaggtagaggagtcgtagtatttactactccgacctactacctagtacgacaacncgtactagtagttagtttggtcgtttcgggtcgggtaccgggtaccgggtaaccgtaacggttcgtaacccggttccgtaccgtacgaccggacccgaacggccgttcccccgg

SEQ ID NO: 432259 - DNA, 611 bp, Homo sapiens
  misc_feature: GZ8MTXP02H5GKR.8.53.E09.1.454.CMB.2.raw
  modified_base (173)..(173): a, c, t, g, unknown or other
  modified_base (225)..(225): a, c, t, g, unknown or other
  modified_base (251)..(251): a, c, t, g, unknown or other
  modified_base (347)..(347): a, c, t, g, unknown or other
tcagctcgcgtgtccacgaccggtgctcgatttagagagagtgtgttgggtttgggggcacaagaggcagcactcaggacaatctccagcatggcctggtctcctctcctcctcactctcctcgctcactgcacagggtcctgggcccagtctgtactgacgcagccgccctnagtatcgtcggggccccagggcaggaggtctccatcctcctgcacgtgggancagaaccagcagtcggggcaggttangatgttcattggtaccgctaggtccaggcacacgcccccagactcctcattaatgaataacaacaatcggccctgaggggtctctgaccgtattcnctcgcctaccagtcctggcctacttcctcgcccttacccgtgttcattctctggtctccgaggggtcaggatgagtctagtatttacgttactcgtacctacttacctatcgaacaacgtagacctaggtaaacgtttgtttcgggacgtttcgggtttccggggacgggtaccggggtaacccgttaaaggttttccggaacccggtttacccgtaaccggttaccgaaccggacccccgtaaacggggtcccttcccccggg

SEQ ID NO: 432260 - DNA, 647 bp, Homo sapiens
  misc_feature: GZ8MTXP02HBAZ5.8.53.E09.1.454.CMB.2.raw
  modified_base (174)..(174): a, c, t, g, unknown or other
  modified_base (223)..(223): a, c, t, g, unknown or other
  modified_base (310)..(310): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctnagtatcgtggggccccagggcaggaggtctccatctctgcacgtgggancaagaaccagcagtcggggctaggttatgatgtcagttcggaccgctaggtccaggcacaccgcccccagacctcctacaacttaanagaaactaaaacaaacaaacgtccggacccctacgacgggggtcctcgtccgaaccgtattcctcgtcgccctacgtacgtcgtcggccttaccttcctcgccccttcccgtgtccaagttctcgtcggtcttaccggaggggttgaggtagtggaacgggtctaggtaatttacttaacgtcgaccctaacttcccttaaagacgaaccacgtacgtacgtagtacgtttacggttcggtcggttcgggtccgggaccgggaccgggtaaccgtaacggtaccggtaacccgtaccgtaacggtccgaaccggacccgtaacggtcccgtccccgg

SEQ ID NO: 432261 - DNA, 590 bp, Homo sapiens
  misc_feature: GZ8MTXP02FTQD4.8.53.E09.1.454.CMB.2.raw
  modified_base (223)..(223): a, c, t, g, unknown or other
  modified_base (309)..(309): a, c, t, g, unknown or other
  modified_base (428)..(428): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcacgtgggancaagaaccagcagtcggggctaggttatgatgttcattggtaccgccgaggttccaggcacgacgcccccagacctcctcattaangaataaacaacaatccggccctcgaggggtctcgtcgacccgtattctctcgcccttacgagtctggctacttctcgccctccctgtcattatcgttggtctccgaggggttgaggtanggagtctagtatttacttaccttccacttcctatcgaacaacgtacgtcctagtacgttagtttcggcgttgggttccgggacgggtacgggtaaccctaacggttcgaacccgttccgtaccggtcgaaccggcccgtaacgggtcctacccgtcccccgg

SEQ ID NO: 432262 - DNA, 538 bp, Homo sapiens
  misc_feature: GZ8MTXP02HX00N.8.53.E09.1.454.CMB.2.raw
  modified_base (224)..(224): a, c, t, g, unknown or other
  modified_base (281)..(281): a, c, t, g, unknown or other
  modified_base (302)..(302): a, c, t, g, unknown or other
  modified_base (336)..(336): a, c, t, g, unknown or other
  modified_base (424)..(424): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtggggccccagggcagagggtctccatctcctgcacgtgggancagaaccagcagtcggggctaggttatgatgttcattggtaccgcaggtcaggcacncgcccccagactcctcataangaataaacaacaaatccggccctgaggggtctcncgaccgattctctcgcctacagtctgctacttctcgcctccctgtcatactctggtctccgagggtgagagtgagctgtattattacngacctactccatcgacaacacgcctgtaagttgttggtctcggttcgggcgggtacggaccgtaaggttcggtaacccgtcccgtacgtacacggacccgaacggcctccccgg

SEQ ID NO: 432263 - DNA, 537 bp, Homo sapiens
  misc_feature: GZ8MTXP02IQP6L.8.53.E09.1.454.CMB.2.raw
  modified_base (224)..(224): a, c, t, g, unknown or other
  modified_base (453)..(453): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccagggcaggagggtctccatctcctgcacgtgggancagaaccagcagtcggggcaggttatgatgttcattggtaccgccaggttccaggcacacgcccccagactcctcattaatgaataacaaacaatcggccctcgaggggtctctcgaccgattctctgccctccagttctggctacttctgcccttccctgtcatatcgtgtctcgagggtgaggtatggaggtctagtatttattactgcctactcctatgacaaacngtcctgacgttatttggcttggttcggcggtccggggaactaggttcgaaccgtctacgtacgacgtacccgaacggctcccgg

SEQ ID NO: 432264 - DNA, 692 bp, Homo sapiens
  misc_feature: GZ8MTXP02GK2MR.8.53.E09.1.454.CMB.2.raw
  modified_base (223)..(223): a, c, t, g, unknown or other
  modified_base (313)..(313): a, c, t, g, unknown or other
  modified_base (347)..(347): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtggggccccagggcagaggtctccatctcctgcacgtgggancaagaaccagcagtcggggctaggttatgatgttcagttcggtaccgcgtaggttccaggcacaccgccccagacctcctactaattaanagaataacaaacacgtccgccctgacgggtctcncgaccgtattctactcacctacagtcgtcggacctacttccgtacgcccttcccgtgtctacttatccgttcgtcccgtcggtaggggtaggtaggagtacgggtacggtacttaggttaaacttttaacgttaccgtaccggtaccccttaacctttaccccttaaagttaaccggaaaaccaaaaccggtaccgtacccgttagttaacggtttagttttcgggtcgggtttaccggggtttccgggggaccgggttacccggggaaaccgtaacgggtttcccgaaccccgtttcgtaaccgtaccgaaccggtaacccggtacgtacccggttccccccgg

SEQ ID NO: 432265 - DNA, 666 bp, Homo sapiens
  misc_feature: GZ8MTXP02G9PRG.8.53.E09.1.454.CMB.2.raw
  modified_base (225)..(225): a, c, t, g, unknown or other
  modified_base (234)..(234): a, c, t, g, unknown or other
  modified_base (253)..(253): a, c, t, g, unknown or other
  modified_base (318)..(318): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtcggggccccagggcaggaggtctccatctcctgcacgtgggancaagaaccngcagtcggggctaggttangattgttcattcggtaccgcgaggttccaggccacgacgcccccagaccttccgtctaatttaangaataaacaaaacaacgtccgccctcgaacggggtcctcgtaccgaccgtatttcctcgtcgtaccctacgacgtcgtcggcctacttcctcgccccttacccgtacgtactaacttcgttccgttcggtaccgttcccggtagggggttacgacgggtaacgttgggaacgggtctaggttaaatttacgttacgtacgtaccctacttacctaagttacgaacaaacgtgtaccgtagtacgtttacgttcggtgttcgggttcgggccgggacggtaaaccgtaacggttccggaacccgttaccgttaccggtacgacgtacccggaacgtccgttacccccgg

SEQ ID NO: 432266 - DNA, 764 bp, Homo sapiens
  misc_feature: GZ8MTXP02HA2ZT.8.53.E09.1.454.CMB.2.raw
  modified_base (223)..(223): a, c, t, g, unknown or other
  modified_base (242)..(242): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtggggccccagggcagagggtctccatctcctgcactgggancagaaccagcagtcggggntaggttatgatgttcagttcggtaccgcctaggtccaggcacacgccccagacctcctacattaatgaactaaacaactaacgtccggcccctacgaggggtcctcgtaccgacccgtatttcctctcgtaccccttacgagttccgttaggccttaccgtttcctacggtcccccttcccgttaggtcctaacgtttaccgttccgttcggggttcccgggtttaccgggggtacggtaacgggtacgtaggggtaacgggtccgttaaggttaactttaacgtttaccgttcgtacccctaaccttcccttaaagtaccggaaaccttaaaccgacggtacccgtttaaggtaacggtttaacggtttccggggtactttacgggggtttcccggggaacccgggggtacccggggttaaaccgtaaaacgggtttcccggtaaaccccgttcccggttaaaccgttccggaacccggtaccccggtaaacggggtcccccttacccggttcccccccgg

SEQ ID NO: 432267 - DNA, 617 bp, Homo sapiens
  misc_feature: GZ8MTXP02JCIGH.8.53.E09.1.454.CMB.2.raw
  modified_base (222)..(222): a, c, t, g, unknown or other
  modified_base (353)..(353): a, c, t, g, unknown or other
  modified_base (413)..(413): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggancagaaccagcagtcggggctaggttatgattgttcattcggtaccgccgtaggttccaggccacgaccgccccagcctcctactattaatgaataacaacaactcgccctgagggtctctccgacacttcnctcgcctctagtctggactcgttctcgccctaccgtgtcctaagtctcgtggtcctacgnggggtgaggtatggacgttctagtatttacgtactcgccttaacctccctaagtacgaaccaaacgcgtaccgtgaacgtttactttcggggccttcggggttccggggccgggttacccggggaaccttaagggtttcccggaaccccgttcccggtttaaacggtcccgaacggcccccggtaacggtccctttcccccggg

SEQ ID NO: 432268 - DNA, 736 bp, Homo sapiens
  misc_feature: GZ8MTXP02GIV52.8.53.E09.1.454.CMB.2.raw
  modified_base (251)..(251): a, c, t, g, unknown or other
  modified_base (303)..(303): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcacgtgggagcagaaccagcagtcggggctagggttangattgttcattggtaccgctaggttccaggcacacgcccccagacctcctanaattaatagaaactaaacaactaacgtccggaccctacggacgggtcctacgtacccgaccgtactttccgtactccgtacccttaccgtacgttccgtacggtaccttaccgtttccgtccgtcccccttcccgttacggtaccttaaagtttaccgttccgttaccgggttacccgttacccgggtaagggggtttacgaacggggtacgttacgggaacgggttcctttaggtaaacttttaacgttaccgtcgaccctacttaccctaagtacgaaccaaacgacgtccgtaggtaagtttacggttcggtcgtttcggggtaccgggtaccggggtacccgggggtaacctaacgggtttcccgaaccccggtttcccgttaccggaaccgacccggtacccggtaaacggtcccccgttcccccggg

SEQ ID NO: 432269 - DNA, 599 bp, Homo sapiens
  misc_feature: GZ8MTXP02I6NIC.8.53.E09.1.454.CMB.2.raw
  modified_base (225)..(225): a, c, t, g, unknown or other
  modified_base (251)..(251): a, c, t, g, unknown or other
  modified_base (298)..(298): a, c, t, g, unknown or other
  modified_base (349)..(349): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatcgtcggggccccagggcagagggtctccatctcctgcacgtgggancagaaccagcagtcggggcaggttangatgtcattggtaccgcaggttccaggcacacgccccagacctcctnattaatgaataacaacaatccggccctgacggggtctctcgaccgtattcnctcgcctcagtctggcctacttctcgcccttccctgtctatactcgtgtccctacgaggggtgacggtatggagtcgtagtatttacttacgtcgccctacttacctagtacgaactaacgacgtcctagtacgtttacgtttcgggtcgttcgggttccgggacgggtaccgggtaaaccgtacggtttaccggaacccgttacctaaccggtccgaaccggaccccgtaacgggtcccttcccccggg

SEQ ID NO: 432270 - DNA, 717 bp, Homo sapiens
  misc_feature: GZ8MTXP02FK83I.8.53.E09.1.454.CMB.2.raw
  modified_base (230)..(230): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatccgtcggggccccagggcaggagggtctccatcctcctgcacgtggggancaagaaccagcagtcggggctagggttatgattgttcattcggtaccgccgtacggttccaggccacacgcccccagacctcctactaattaagagtaactaaaaccaaaccgtaacgtcccgggtacccctaccggtaacggggttccttacggtacccggtaacccgttactttccgtaccgttccgtaccccgttaaccgtacgttccgtccgggtaccttaccgtttctccgtccccgtcccgttcggtactacgttactccggttcggttacccttacgggaggggtagaggtagaggacggtactagttaacttactttacgcgtcctaaccttcctaagtacgacaacgtaccgtacgtagtagtttacggtttcggtacggttcggttccggggaccgggaccgggtaaccgtacggttaccgtaacccggttacgtaacccggtaccgaccgacccggtaacggtcccgtcccccggg

SEQ ID NO: 432271 - DNA, 593 bp, Homo sapiens
  misc_feature: GZ8MTXP02JMLAF.8.53.E09.1.454.CMB.2.raw
  modified_base (176)..(176): a, c, t, g, unknown or other
  modified_base (208)..(208): a, c, t, g, unknown or other
  modified_base (228)..(228): a, c, t, g, unknown or other
  modified_base (236)..(236): a, c, t, g, unknown or other
  modified_base (247)..(247): a, c, t, g, unknown or other
  modified_base (259)..(259): a, c, t, g, unknown or other
  modified_base (268)..(268): a, c, t, g, unknown or other
  modified_base (302)..(302): a, c, t, g, unknown or other
  modified_base (349)..(349): a, c, t, g, unknown or other
  modified_base (395)..(395): a, c, t, g, unknown or other
  modified_base (450)..(450): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagcccgccctnagtatcgtcggggccccagggcaggagggtcnccatctcctgcacgtgggancagaaccngcagtcggggnaggtatgatgtnattggaccncaggtcaggcacacgccccagctcctacattaangaataaacaacaagtccggccctcgaggggtctcgtcgacgtattcnctcgcctacagtctggtctactcgtcgtcctccgtgtctacttacncgttcgtcctcgagggtgaagggtatacggaggtactggtaaatttacgttacgngtaccctaactcctagtacacaactacgctagtacgttagttcggtactcgggttcgggaccggtacggggtaaccctaaggttcggaaaccccgttccgttaaacccgtcgaacggacccccgtaaacgggccttaccccgg

SEQ ID NO: 432272 - DNA, 555 bp, Homo sapiens
  misc_feature: GZ8MTXP02ISQAM.8.53.E09.1.454.CMB.2.raw
  modified_base (225)..(225): a, c, t, g, unknown or other
  modified_base (370)..(370): a, c, t, g, unknown or other
  modified_base (439)..(439): a, c, t, g, unknown or other
tcagctcgcgtgtccacgaccggtgctcgatttagagagagtgtgttggggtttggggggcacaagaggcagcactcaggacaatctccagcatggcctggtctcctctcctcctcactctcctcgctcactgcacagggtcctgggcccagtctgtactgacgcagccgccctcagtatctggggccccagggcaggagggtctccatctcctgcacgtgggancaagaaccagcagtcggggcaggttatgatgttcattggtaccgcaggttccaggcacacgcccccagactcctcattaatgaataacaacaatcggccctgacggggtctctcgaccgattctctgcctcagtctggcacttcngcctcctgtcatatctgtctcgagggtgagatgagtctagtattattactcgcactctatacgacaacngtacctgagttacgtttggcgttcggttacggggcgggtaccggggtaaccgtaaggtttccggaacccggttccgtaccggtaccgacggtacccgtaacggcccgtttccccgg

SEQ ID NO: 432273 - DNA, 735 bp, Homo sapiens
  misc_feature: GZ8MTXP02G4YO5.8.53.E09.1.454.CMB.2.raw
  modified_base (228)..(228): a, c, t, g, unknown or other
  modified_base (260)..(260): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacgagggtcctgggcccagtctgtactgacgcagcccgccctcagtatcgtcggggccccagggcaggacggtctccatctcctgcacgtgggancaagaaccagcgaggtcggggactagggttangtattgttactacgttacggtacccgacgtacggttaccgacggccaccgacccggaccccccaagtacccttacctacgtaaactttaagtacgtaaactaaaaccgaactaacgtcccggtaccctacggtcgggtccttacgtacccgaccgtacgttcctcgtccgtaccctacgacgttcgtacggccttaccttcgtccgtcccgttacccgtgtaccttattccgttcgtcggttacccgtacgggttagggggagtaacgggtacttacggggacgttacgttagtttaaacttttaccgttaccttacccgtacttaccgtaagtaccgaactacgtaccgcgttagtacgtttacgttcggtacggttccgggttacggggaccgggtacggtacgtaaccggttaccggtaccgtaaccgtacggtaccgacggtaacccgccggtcccgtcccggttcccccg

SEQ ID NO: 432274 - DNA, 712 bp, Homo sapiens
  misc_feature: GZ8MTXP02GDCVG.8.53.E09.1.454.CMB.2.raw
  modified_base (175)..(175): a, c, t, g, unknown or other
  modified_base (226)..(226): a, c, t, g, unknown or other
  modified_base (236)..(236): a, c, t, g, unknown or other
  modified_base (518)..(518): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgaccgcagccgccctnagtatcgtcggggcccagggcagagggtctccatcctcctgcacgtgggancaagaacccngcagtcgggggactaggttatgtattgtctagttcggtaccgcgtaggttccgaggacacgacgcccccagacctcctactaattaatagaactaaaacaaacctaaacgtcccggtacccctacgacggggttcctacgtaccggtacccgtatttccgtccgtcgtaccccttacgtacggttcctcggtaccttacctttccgtacgtccccttcccgtacggtacctagttacgttccgttcggttacccttacgggacgggggttagaaacggggtntacggggacgggtaccttaggtaactttacggttactacggtacctactacccttagacgaaaccaaacgtcgtaccgtaggttacgtttagttcggtacgttccgggttaccggggacggtaccgggtaaactaacggtttacgaacccggttaactaccggtaccgaccggaccgacggtcccgtaccccgg

SEQ ID NO: 432275 - DNA, 496 bp, Homo sapiens
  misc_feature: GZ8MTXP02IERX0.8.53.E09.1.454.CMB.2.raw
  modified_base (249)..(249): a, c, t, g, unknown or other
  modified_base (270)..(270): a, c, t, g, unknown or other
  modified_base (433)..(433): a, c, t, g, unknown or other
  modified_base (439)..(439): a, c, t, g, unknown or other
  modified_base (483)..(496): a, c, t, g, unknown or other
tcagctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggcctcgaggggtctctgaccgattctctgcctccaagtctggctactttctcgcctccctggtcatntctggtctccgagggtgaggntgaggctgattattactgccctactcctatgaacaacagcctggtaagttatttgggcttggttcgggcgggcggggactaggttcgaccgttcctacgtcacgcccgaagggcctccggacccccttcgggtcctaccgtctcgttcccccgccccttaccnccgacncgcgagccgtggacggcgggcgtcggacgacggcgacaagtgcnnnnnnnnnnnnnn

SEQ ID NO: 432276 - DNA, 555 bp, Homo sapiens
  misc_feature: GZ8MTXP02H5XF5.8.53.E09.1.454.CMB.2.raw
  modified_base (175)..(175): a, c, t, g, unknown or other
  modified_base (224)..(224): a, c, t, g, unknown or other
  modified_base (232)..(232): a, c, t, g, unknown or other
  modified_base (250)..(250): a, c, t, g, unknown or other
  modified_base (266)..(266): a, c, t, g, unknown or other
  modified_base (305)..(305): a, c, t, g, unknown or other
  modified_base (351)..(351): a, c, t, g, unknown or other
  modified_base (374)..(374): a, c, t, g, unknown or other
  modified_base (392)..(392): a, c, t, g, unknown or other
  modified_base (413)..(413): a, c, t, g, unknown or other
  modified_base (415)..(415): a, c, t, g, unknown or other
  modified_base (418)..(418): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagcccgccctnagtatcgtcggggcccaggggcaggaggtctccatctcctgcatgggancagaaccngcagtcggggcaggttangatgtcattggtaccncgaggtccaggcacacgccccctagactcccatattaangaataacaacaactcggaccctgacgggtctctacgaccgtcttcnctcgcctacagtctggctacttntcgacctcccagttcatntctggtctcgagggtcaggangngtntagtattacttactacctactactactacgacacacgtcgtagtagttacgttacgtcgttcgtcgggtacgggtacggtacgtacgttacgtaccgtaaccgtacgtacgacgtaccgacgtaccgtaccgtcccg

SEQ ID NO: 432277 - DNA, 585 bp, Homo sapiens
  misc_feature: GZ8MTXP02JEB45.8.53.E09.1.454.CMB.2.raw
  modified_base (221)..(221): a, c, t, g, unknown or other
  modified_base (320)..(320): a, c, t, g, unknown or other
  modified_base (361)..(361): a, c, t, g, unknown or other
tcagctcgcgtgtccacgaccggtgctcgatttagagagagtgtgttgggtttgggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggancagaaccagcagtcggggcaggttatgatgttcattggtacgccaggttccaggcacagcccccagactcctcattaatgataacaacaatcggccctnaggggtctctgaccgattctctgcctcagtctggcacttcngcctccctgtcatatctggtctccagggttcgaggatgagtctgtattagttactgcctaactccctatagactaaacacgtcctagagttacgttttgggctttcgggtttaccgggccgggtaccgggggtaaaccctaaagggtttaccggaacccggttaccccgttaaaccggttccgtaacggacccccgtaaacggggtcccgtttaacccccgggg

SEQ ID NO: 432278 - DNA, 609 bp, Homo sapiens
  misc_feature: GZ8MTXP02IRU4L.8.53.E09.1.454.CMB.2.raw
  modified_base (175)..(175): a, c, t, g, unknown or other
  modified_base (255)..(255): a, c, t, g, unknown or other
  modified_base (303)..(303): a, c, t, g, unknown or other
  modified_base (311)..(311): a, c, t, g, unknown or other
  modified_base (315)..(315): a, c, t, g, unknown or other
  modified_base (419)..(419): a, c, t, g, unknown or other
tcagctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgcccctnagtatccgtggggccccagggcaggagggtcctccattctcctgcacgtgggacagaccagcagtcggggactaggttangattgtactagttggaccgcgaggtccaggcacgacgccccagactcnctattaangaanaacaacaatccgcctcgagggtctcgtcgaccgtattccgtctcgtccctacccaggttcgtacggacctaccgttctcgtcccttacccgttcgtactaattntccgttcgtccgttaccgtaggggtgtacggataggaggtctagttaattatttactcgtcctaactcctaggtacaacaaacgcgtaccgagtaggttagtttcgtacgtcgggtttccgggacggtaccggaacgtaagtttcccgaagttcccgtaacgtccggaccgaccgaaccggtctccccgg

SEQ ID NO: 432279 - DNA, 854 bp, Homo sapiens
  misc_feature: GZ8MTXP02ILYRB.8.53.E09.1.454.CMB.2.raw
  modified_base (228)..(228): a, c, t, g, unknown or other
tcagctcgcgtgtccacgaccggtgctcgatttagagagagtgtgttgggtttgggggggcacaagaggcagcactcaggacaatctccagcatggcctggtctcctctcctcctcactctcctcgctcactgcacagggtcctgggcccagtctgtactgacgcagccgccctcagtatcgtcggggcccagggcaggacgggtctccatcctcctgcacgtgggancaagaaccagcagtcggggactaggttatgattgttcagttcggaccgctaggttccaggccacgaccgacccccagtaccttcctactaatttaaactgtaaaactaaacctaaaactaacgttacccggaccccgttaggtacggggttacctccgtaccgtaacccgtactttcccgtcgttcgtaccccttacctacggtttccgtacgggacccttacccgttttcccgtcgtcccccgtttacccggtacggttacctaacgtttacgttccgttcggggtttacccgtacccgggtagggggttacggaacggggtaagttacgggtacggttacgtttaacgggtttaaacttttaaaccggtttaccgttacccgtaccccgttaaaccgtttaccccgtaagttaaccggaaaccgtaaaccgttaacgttacccggtaaggtttaacgttttacggtttacgggttaccggttacggggttttaccgggggacccgggttaaccgggggtaacccgtttaacggggtttacccggtaaccccggttttaccccgttaaccgggtacccgtaacccggtaccccggttaacgggtcccccggtttacccccccggg

SEQ ID NO: 432280 - DNA, 667 bp, Homo sapiens
  misc_feature: GZ8MTXP01B0TT2.52.60.F05.1.454.CMB.2.raw
  modified_base (221)..(221): a, c, t, g, unknown or other
  modified_base (244)..(244): a, c, t, g, unknown or other
tcagcgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganattattctagtacaaaccgtttntgtcttagtcgacagacagacgccgacggccgacggtcccgttggttggttaggtagtaataagtaagtaaacggtacacgtaggaacggtaccggtaccccgtacgggacggtaccttcccgtagacgtaccgtacgttccgtcgtcccggacctaccgacccgtacgacggaaacctacgtcgtaccgtacgttacgacctagtacgagggtacggacgtacgaaggacgaagggaacggacggacgacgtacgacctaccgacgtactaacaacacgaaacgacgacacgtacgttagttcgtttacttagtcgttccgtacgaccgtaacggtaacggtaaccgttacggtccaccgtacgtacgaccgaccgacccgaaccgtaccccaaccgtctacgttacctccgttccgtcccg

SEQ ID NO: 432281 - DNA, 538 bp, Homo sapiens
  misc_feature: GZ8MTXP01BHNOO.52.60.F05.1.454.CMB.2.raw
  modified_base (219)..(219): a, c, t, g, unknown or other
  modified_base (238)..(238): a, c, t, g, unknown or other
  modified_base (416)..(416): a, c, t, g, unknown or other
  modified_base (427)..(427): a, c, t, g, unknown or other
tcagcgcagtacgacacgaccggtgctcgatttagtacgtcatcagggaaagggggtgggtccaggaggcagaactctgggtgtctcaccatggcctggatccctctacttctcccctcctcactctctgcacaggctctgaggcctcctatgagctgacacagccaccctcggtgtcagtcgtcccaggacagacggccaggatcacctgctctgganatattctgtacaaacgttntgtcttattggtaccagcagaagccaggccaggccctgtgtggtgatatataaaggacactgagacggccctagagggactcccgtgagcgtattctctcggccttcacctcgaacgggaacactgtcacgttcgactatcagtgacgtccaggcaggaggacgagctagactacagntacaatacaanagtacagcagttgtctagtgtctcgacacgtcggacttaaacggtccaccgtacgtagttaccgcgacccgaacggccccaaaccctctcgttaccctcgttctttccccg

SEQ ID NO: 432282 - DNA, 569 bp, Homo sapiens
  misc_feature: GZ8MTXP01EXSNQ.52.60.F05.1.454.CMB.2.raw
  modified_base (220)..(220): a, c, t, g, unknown or other
  modified_base (240)..(240): a, c, t, g, unknown or other
  modified_base (369)..(369): a, c, t, g, unknown or other
  modified_base (405)..(405): a, c, t, g, unknown or other
  modified_base (543)..(543): a, c, t, g, unknown or other
tcagcgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtacaaaccgttntgcttattggtaccagcagaagccaggccacggcccctgtgttggtgatatataaggacactgagacgccctgagggactcccgtgagcgtattctcgtcggcctcactcgaggaacactgtcacgttnacatcgagtgacgtaccaggacaggaggacgaaggntacgactaccatagtacaatacaaacgagaccagctaaggttgtttacttagtgtcttacgactaaaggtcgggaaaccttacgggtaccacccggttctaacggccgaccgaccccgaaacggccccaaaccccgtntacgttcctaaccgttcttaaccccg

SEQ ID NO: 432283 - DNA, 677 bp, Homo sapiens
  misc_feature: GZ8MTXP01ARKIT.52.60.F05.1.454.CMB.2.raw
  modified_base (217)..(217): a, c, t, g, unknown or other
  modified_base (235)..(235): a, c, t, g, unknown or other
  modified_base (246)..(246): a, c, t, g, unknown or other
  modified_base (253)..(253): a, c, t, g, unknown or other
  modified_base (272)..(272): a, c, t, g, unknown or other
  modified_base (331)..(331): a, c, t, g, unknown or other
tcagcgcagtacgacacgaccggtgctcgatttagtacgtcatcagggaaagggggtgggtccaggaggcagaactctgggtgtctcaccatggcctggatccctctacttctcccctctcactctctgcacaggctctgaggcctcctatgagctgacacagccaccctcggtgtcagtgtccccaggacagacgccaggatcacctgctctgganatattctgtcaaacgttngcttatgcacngcagacncagcacgccctgtcgtggngacttatagtaacggacctagtagagacggcccctagacgggtactccgtagacgcgtnttcgtccgaggtcttacccgaaccgtcgaaacgggacctaacgttacgtcccgtaacgttaccgaaacctcgttaccgaaagggttcggtaacgtcccggaaaggccgaagggaacgggacgtaacgggtctacggaaccctaaccgtacttacgtaccaaacgttcaaacgtacgaactacgaacgttggtttacgtttaacttacgtcgttacgttaccgctaaacggttcggggaaacctaaaccggttcccgtaaacccggtttccgacggttacccaccgggaacccgaaacccggaacccttaaaccccggcttttaggcccccgttaacgtttccccgg

SEQ ID NO: 432284 - DNA, 840 bp, Homo sapiens
  misc_feature: GZ8MTXP01BDSPF.52.60.F05.1.454.CMB.2.raw
tcagcgcagtacgacacgaccggtgctcgatttagtacgtcatcagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggatatattctgtactaaacgttatgtctttagttggtaaccagcaagaacgccaggccacggccccttggtgttggtagatataagtaaaggacacgtggagacggccctacgaggtactcccgtgacgtcgtattccgtcgtccggcctaccgaccgttacggaacggggtaaacctaaccgttaacgtaccgtaaccgggtttaccgaaaccctagtacccggtaagggttacgggaaccgttacccggaaacggggacccggaaaggggttaacggggaaccggaaacggggtccgtttaaccgggaaacccttaaccccggaaacttaacggtttaaccgaaaacgttaaccgaaaaccgtaaacggaaacccgtaaggtaaccgttaaagggtttcggttttaaccctttaggtttcgtttacccgtttaccggtaaccgtaaccgggtttaaccgggggaaaccccgttaacgggttaccccgttaaaccccggtttaccggtttaaccgggaccccgttaacccgggttaacccccggaaacgggtaccccccccgaaaaccccttacccgggttaccgttaccccttaacccgtttccccgttttaacccccccg

SEQ ID NO: 432285 - DNA, 491 bp, Homo sapiens
  misc_feature: GZ8MTXP02I3RLI.52.60.F05.1.454.CMB.2.raw
  modified_base (219)..(219): a, c, t, g, unknown or other
  modified_base (238)..(238): a, c, t, g, unknown or other
  modified_base (310)..(310): a, c, t, g, unknown or other
  modified_base (436)..(436): a, c, t, g, unknown or other
tcagcgcagtacgacacgaccggtgctcgatttagtacgtcatcagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtcaaaccgttntgcttattggtaccagcagaagccaggccaggcccctgtgttggtgatatataaggacactgagaggccctnagggatccctgagcgattctctggctccacctcagggacactgtcacgttgaccatcagtgatccaggcagagacgagctgactacactgtacaatcaacagacagcagtgttctatgtcttcganactgggaccaaggtcacgtctaggcagccaaggcccaacccactgccactctccg

SEQ ID NO: 432286 - DNA, 528 bp, Homo sapiens
  misc_feature: GZ8MTXP02I4B2J.52.60.F05.1.454.CMB.2.raw
  modified_base (238)..(238): a, c, t, g, unknown or other
  modified_base (414)..(414): a, c, t, g, unknown or other
tcagcgcagtacgacacgaccggtgctcgatttagtacgtcatcagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttntgcttattggtaccagcagaagccaggccaggcccctgtgttggtgatatataaggacactgagaggcctcagggatccctgagcgattctctggcctccacctcagggaccactgtcacgttgaccatcagtgagtccaggcagagcgaggctgactaccactgtacaatcaacngacagcagtggttcttatgtcttcgctaactcgggaccaaaggtccctaaacggtccttaacgggtccacgaccccgaaggcccaaacccctacgtcgtaccactctttacccg

SEQ ID NO: 432287 - DNA, 496 bp, Homo sapiens
  misc_feature: GZ8MTXP02GZCIR.52.60.F05.1.454.CMB.2.raw
  modified_base (236)..(236): a, c, t, g, unknown or other
  modified_base (483)..(483): a, c, t, g, unknown or other
tcagcgcagtacgacacgaccggtgctcgatttagtacgtcatcagggaaagggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatattctgtcaaaccgttntgcttattggtaccagcagaagccaggccaggcccctgtgttggtgatatataaggacactgagaggccctcagggatccctgagcgattctctcggctccactcagggacactagtcacgttgaccatcagtggagtccaggcagaggacgaggctgactaccactgtacaatcaacagacagcagtgttctatgtcttgcaactcggacaaggtcacgtctacggtcagcccaaggccaacccgntcgtcactctccg

SEQ ID NO: 432288 - DNA, 501 bp, Homo sapiens
  misc_feature: GZ8MTXP02JAS40.52.60.F05.1.454.CMB.2.raw
  modified_base (239)..(239): a, c, t, g, unknown or other
  modified_base (419)..(419): a, c, t, g, unknown or other
  modified_base (487)..(487): a, c, t, g, unknown or other
tcagcgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttntgcttattggtaccagcagaagccaggccaggcccctgtgttggtgatatataaggacactgagaggccctgagggactccctgagcgtattctctcggcctccactcgagggacactgtcacgttgaccatcgagtggactcgaggcagaggacgaggctgactacatgacaatcaacngacagcagtgtctatgtctcgcacgtcggacaagtcaacgtctaggtacacgaccgaagcccaacccnctcgacactcgtcc

SEQ ID NO: 432289 - DNA, 526 bp, Homo sapiens
  misc_feature: GZ8MTXP02HFD24.52.60.F05.1.454.CMB.2.raw
  modified_base (221)..(221): a, c, t, g, unknown or other
  modified_base (509)..(509): a, c, t, g, unknown or other
tcagcgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatattctgtacaaaccgttatgctttattggtaccagcagaagccaggccaggcccctgtgttggtgatatataaggacactgagaggcctgagggactcccgtgagcgtattctctcggcctccacctcgacgggacactgtctacgttgacctatcagtcggatccgaggcaggaggacgagctgactaacactgtacaaatcaacagacagcagtggttacttagtctcttcgacacgttcggaaccaggtccaacggtctaggcacgaccaacgtacccaaccnctcgccacgtctacccg

SEQ ID NO: 432290 - DNA, 545 bp, Homo sapiens
  misc_feature: GZ8MTXP02FOTKQ.52.60.F05.1.454.CMB.2.raw
  modified_base (239)..(239): a, c, t, g, unknown or other
  modified_base (454)..(454): a, c, t, g, unknown or other
tcagcgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttntgctttatggtaccagcagagccaggccaggcccctgtgttggtgatatagtaaggacactgagacggccctcgagggatccccgtgagcgattctctcggcctccacctcgagggaccactagtcacgttgaccctaatcagtggagtccgaggcaaggaggacgaggctggacctacactgtacaatcaacagacagcagttggttcttagtntacgttcgcaaacgtcggaaccaaggtccaccgtccgtacgggtccacgacccaaacggcccaaaccccgactacgctacctcttacccgg

SEQ ID NO: 432291 - DNA, 662 bp, Homo sapiens
  misc_feature: GZ8MTXP02IPGDO.52.60.F05.1.454.CMB.2.raw
  modified_base (220)..(220): a, c, t, g, unknown or other
  modified_base (239)..(239): a, c, t, g, unknown or other
  modified_base (283)..(283): a, c, t, g, unknown or other
tcagcgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgganatattctgtacaaacgttntgtcttagttggtaccagcagagcaggccaggccctgtgttggngatatataagacactgagacggcctgagggactcccgtagacgacgtattctcgtacggcctaccaccgtgacgggaccacgtcgtctacggtttacgaccctaatcgaaggttcggagtcccgaggaccagggacggacggagggctacggaaccgtaccacgtacgtaccaaattaccgaaaacaggaaccgacggaaccgtaggtttacggtttactttaacgtacgtttaccgttccgaacgtaaaaccggttcggggaaacccgttaaaggggtcccctaaacccggttaccgtacgggttacccaaccggaccccgaaaacggcccccaaaaccccgtcttaccggtaccctaaccgtttccgttacccccgg

SEQ ID NO: 432292 - DNA, 747 bp, Homo sapiens
  misc_feature: GZ8MTXP02GREIU.52.60.F05.1.454.CMB.2.raw
  modified_base (274)..(274): a, c, t, g, unknown or other
  modified_base (729)..(729): a, c, t, g, unknown or other
tcagcgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagcccacctcggtgtcagtcgtccccaggacagacggccaggatcacctgctctggagattattcgtgtacctaaaccgttatgtctttagttcggtaccagacaggaacnccgacggccacggcccctggtgttcggtagattaagtagtaaggactacgtagacgtacggccctacgacggtactacccgtggacgtccgttattcccgtcgtcccgggtacccctacccgtacccgtaccggtaacggggaccctaaccggttaccggtaccgtaaccggtttccggaaaccctaattacccggagggttaccggggaacttcccggaacgggtccaaaggggacgggtacggaacggaccgtaggaaccctaaccgtacgtacggttaaacgaaacttaaccaaaccgaacggtacgaacggtaccgtaaggtttaccggtttatttacgtacgttaccgttacgacgtaaaccgtacgggggaaccctaaagggtcctaaccggtaacgttcgggaccaacggtcccgaaaccggtcccctaaacccgtacgttcgtaccncctttccggtttaccccg

SEQ ID NO: 432293 - DNA, 563 bp, Homo sapiens
  misc_feature: GZ8MTXP01EY56N.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccacccctcccaaactcctgtcgtacaggaatgacaaccggccctacaaacatttcagagagtactttctactcaaggacaaacaaaatcagcctctctgaccattactgtctccagcctgacgacgaggctgactactactgctcgagtccgtgggaccaccgacgccctcgctcgtcgttggtccgtttcgggcgggtacgggaccaaggccgtacggtacccgttccgttggggttccaacggccccgaagggcctccggcccccgttcgggttcccgtaacccg

SEQ ID NO: 432294 - DNA, 507 bp, Homo sapiens
  misc_feature: GZ8MTXP01CO28N.19.85.H08.1.454.CMB.2.raw
  modified_base (363)..(363): a, c, t, g, unknown or other
  modified_base (452)..(452): a, c, t, g, unknown or other
  modified_base (480)..(480): a, c, t, g, unknown or other
tcagtactctcgtgcacgaccggtgctcgatttagtatcactcagtcgcgggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgcacagtcacctgcaccgggaacaccaaacaatgtcggcgaccagggagccgcttggctgcagcaacgccagggccaccctcccaaactcctgtcgtacaggaatgacaaccggccctcaaacatttcagagagactttctactcagacaaacaaatcagcctntctgaccatactgtctccagcctgacgacgaggctgactactactgctcagcctgggaccaccagcctcgctgcttggctttcggcggngggccaagcgtgcgttccgttgggttcngcccaaggctcgcccctcggttcctcc

SEQ ID NO: 432295 - DNA, 509 bp, Homo sapiens
  misc_feature: GZ8MTXP01AETLS.19.85.H08.1.454.CMB.2.raw
  modified_base (323)..(323): a, c, t, g, unknown or other
  modified_base (455)..(455): a, c, t, g, unknown or other
  modified_base (482)..(482): a, c, t, g, unknown or other
  modified_base (506)..(506): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggatgacaaccggccctcaaacntttcagagagactttcactcaggacaacaaaatcagcctctctgaccattactgtctcagcctgacgacgagctgactactactgctcgacgcctgggacaccacgcctcgctgtcttggtctttcggcggnggaccagcgtgccgttcgttgggttcngcccaaggctcgcccctcggttcnccg

SEQ ID NO: 432296 - DNA, 508 bp, Homo sapiens
  misc_feature: GZ8MTXP01DCFFF.19.85.H08.1.454.CMB.2.raw
  modified_base (261)..(261): a, c, t, g, unknown or other
  modified_base (432)..(432): a, c, t, g, unknown or other
  modified_base (458)..(458): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggcngcagcaacgccagggccaccctcccaaaactcctgtcgtacaggaatgacaacccggccctcaaacatttcagagacgattttcactccaggaacaacaaatacagcctctctgaccattactggtctcagcctgacgacgaggctgactactactgctcagcctgggacnccagctcgctgctggctttcggcggnggaccaagctgaccgttcttgggtcagcccaggcttcgccccttcggtcc

SEQ ID NO: 432297 - DNA, 515 bp, Homo sapiens
  misc_feature: GZ8MTXP01EPLFF.19.85.H08.1.454.CMB.2.raw
  modified_base (490)..(490): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggaatgacaaccggcccctcaaacatttcagagagactttctacctccaggacaacaaaatcagcctctctgaccattactgtctcagcctgacacgaggctgactactactgctcagcctcgggacaccagccctcgctgtcttgtcgtttcggcggtgggaccaagcgtgaccgttccgttgggttcngcccaagcctgcccctcggttcgcc

SEQ ID NO: 432298 - DNA, 528 bp, Homo sapiens
  misc_feature: GZ8MTXP01CF3P7.19.85.H08.1.454.CMB.2.raw
  modified_base (333)..(333): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcgcgaccagggagccgcttggctgcagcaacgccagggccacccctccaaactcctgtcgtacaggaatgacaaccggccctacaaacatttcaganagactttcactcagacaacaaaatcagcctctctgaccattactgtctcagcctgacgacgaggctgactactactgctcgagcctgggacaccacgcctcgctgtcttcggtcttttcgggcggtagggaccaaagcgtcgccgttccgttgggttccaacgcccgaacgctcgccccgtcggttcctaacccg

SEQ ID NO: 432299 - DNA, 356 bp, Homo sapiens
  misc_feature: GZ8MTXP01AKW2D.19.85.H08.1.454.CMB.2.raw
  modified_base (353)..(356): a, c, t, g, unknown or other
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagagagggggcactggctggtcgggtcgatcttttgatttgtgggccaaggatcaagcgtctccgtctcttcagcctccaccaaggcccatcgtctcccctggcaccctcctccaagagcacctctgggggcacagcggccctgggctgcctggtcaaggactacttccccacgagagtactgagcgggctggcaaggcgccatagnnnn

SEQ ID NO: 432300 - DNA, 568 bp, Homo sapiens
  misc_feature: GZ8MTXP01B7IW8.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggaacaccaacaatgtcggctaccagggacgccgcttggctgcagcaacgccagggcccaccctcccaaactcctgtcgtacaggaatcgacaaccggccctacaaacatttcagagacgtacttttcacctccaaggaaacaacaaatacacgccctctctacgacctattactgtctcacgcctgacgacgagctcgactactactgactcacgcctagggaccaccgacgcctacgctcgtccgttcggtccgttttcgggcggttacgggacccaacggtccgtcgttacccggttcgttcgggtccacggcccgaacggccgttccgtccccgttcggtcccg

SEQ ID NO: 432301 - DNA, 524 bp, Homo sapiens
  misc_feature: GZ8MTXP01DM46Z.19.85.H08.1.454.CMB.2.raw
  modified_base (504)..(504): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccgggaacaccaacaatgtcggcgaccagggagccgcttggctgcagcaacgccagggccacccctcccaaactcctgtcgtacaggaatgacaaccggccctacaaacatttcagagagtactttcactcagacaaacaaaatcagcctctctgacctattactgtctccagcctgacgacgaggctgactactactgctcgacgcctgggacaccagcctcgctcgtcttcggctttcgggcggtggaccaagcgtcgaccgttcgttggttcaagcccaaggccncgcccctcggttcgtaaccc

SEQ ID NO: 432302 - DNA, 810 bp, Homo sapiens
  misc_feature: GZ8MTXP01AV87N.19.85.H08.1.454.CMB.2.raw
  modified_base (260)..(260): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggcngcagcaacgccacgggcccacccctcccaaactcctgtcgtacaggaatgaccaacccggccctacaaacatttcagagacgtacttttactacccgtaccaggtaaaccaactaaactacacgacccttactacctacgaaccctatttacctacggttacctacccgacgtcccgttacggaaccggtaaccggtaacgggtccgtacgggtaacccgttaaccttaaaccgttcggtaccctttaccggaaaccgggtccccggtttaccgggggtaaacccctaaccccgaaacccggtacccccggttacccggtcccgttaccgggttcccgggttttaccggggtcccgggtttttttaacccgggggaacccgggggttaaacccgggggttaaaccccgaaaaccggggtcccgttacccgggttaacccccgggttcccgggttaccgggggtttaacccgggtaacccgggaaccccggtaaaaccggggtccccgttaccccgggtccccccccggtttccgggggtttaaccccccg

SEQ ID NO: 432303 - DNA, 544 bp, Homo sapiens
  misc_feature: GZ8MTXP01EEQ49.19.85.H08.1.454.CMB.2.raw
  modified_base (333)..(333): a, c, t, g, unknown or other
  modified_base (362)..(362): a, c, t, g, unknown or other
  modified_base (370)..(370): a, c, t, g, unknown or other
  modified_base (384)..(384): a, c, t, g, unknown or other
tcagtactctcgtgcacgaccggtgctcgatttagtatcactcagtcgcggggtaccaaacagagcttcagcaagcatagtgggaatctgcaccatgccctgggctctgctcctcctgaccctcctcactcactctgcagtgtcagtggtccaggcaggactgactcagccaccctcggtgtccgggggcctggggacaggccgccacagtcacctgcaccggaacaccaacaatgtcggcgaccagggagccgcttggctgcagcaacgccagggccaccctccaaactcctgtcgtacaggaatgacaaccggccctacaaacattcaganagactttcactcagacaacaaaatcaacncctctcanacatactgtcacanctagacgacgagtactgactactactcgactacgacgcgtacggaccaccgacgtccgtcgtctcgtcgttcgttcgtttcggtcggacggacgacgacgtacgtaccgttccgttcggttacgaacgaccgaacgcgtccgttcccgtccgttccgtcg

SEQ ID NO: 432304 - DNA, 539 bp, Homo sapiens
  misc_feature: GZ8MTXP01CRNKP.19.85.H08.1.454.CMB.2.raw
  modified_base (510)..(510): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccgggaacaccaacaatgtcggcgaccagggagccgcttggctgcagcaacgccacgggcccaccctccaaactcctgtcgtacaggaatgactaaccggccctacaaacatttcagagagtacttttcactccagacaaacaaatcagccctctctacgaccattactggtcctccacgtcctgacgacgacggctcgactactactgctcgacgccgtggaccaccacgccgtcgctcgtcttcggtctttcgggcggtacgggaccagcgtcgaccgttccgttgggttcncgcccgaagcctcgcccctcggttctccg

SEQ ID NO: 432305 - DNA, 573 bp, Homo sapiens
  misc_feature: GZ8MTXP01BM77L.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtggtccgggggcctggggacaggccgccacagtcacctgcaccgggaacacaacaatgtcggcgaccagggagccgcttggctgcagcaacgccagggcccaccctcccaaactcctgtccgtacaggaatcgacaaccggccctacaaacatttcagagagtactttcactcagacaaacaaatcagcctctctcgacctattactgtctccacgcctgacgacgaggtctacgactactaactgtctcgacgccgtacgggaccacctacgccgtcgctcgtcgttcggtcgtttcgggcgggtacgggaccgtaagccgtacggaccgttccggttcgggttccgaacggcccgtaacggccgtccggttcccctcgggttccgtaacccg

SEQ ID NO: 432306 - DNA, 523 bp, Homo sapiens
  misc_feature: GZ8MTXP01BP85R.19.85.H08.1.454.CMB.2.raw
  modified_base (367)..(367): a, c, t, g, unknown or other
  modified_base (412)..(412): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctccaaactcctgtcgtacaggaatgacaaccggccctcaaacatttcagagagacttttctactcaggacaacaaaatcagccctcnctgaccattactgtctccagcctgacgacgaggctgactactacngctcgagcctgggacaccagcctcgctcgtcttggctttcgggcggtagggaccagctgacccgttcgttgggttccaagcccaaggcctcggccccctcggttctaaccg

SEQ ID NO: 432307 - DNA, 553 bp, Homo sapiens
  misc_feature: GZ8MTXP01C4BCG.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactggatccgccagctccgaggaagggctggagtggattgcctatgtcactagtgaggcaagtcacgtcctacgcggactcgtggtcgggccggggtcccgggtttaccagtcctacccgaagagaccaagtacgaccaaaggaagacgctctttcgtggactaagttcggacggcctagagagtacgaagacgacggtcttattaattattgtgttgagaggagggggcacgtggcgtgggtggtcgttagttcgtttgtaag

SEQ ID NO: 432308 - DNA, 531 bp, Homo sapiens
  misc_feature: GZ8MTXP01CNRKB.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggacaccaacatgtcgcgaccagggagccgcttggctgcagcaacgccagggcccaccctcccaaactcctgtcgtacaggaatgacaacccggccctcaaacatttcagagacgtattttcacctccaaggaaacaacaaatcaacgcctctctcgaaccattactgtctccagcctgacgacgaggctagactacgtactgactcacgtccctagggaccaccagccctcgctgccttggcgtttcggcggttagggaccagcgtcgaccgttcgttgggtcacgccgagcttcgtccccgttggtccc

SEQ ID NO: 432309 - DNA, 624 bp, Homo sapiens
  misc_feature: GZ8MTXP01DHHKU.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgcacagtcactgcaccggaacacaacatgcgcgacagggagcgctggctgcagcaacgccaggcccaccctccaaactcctcgtcgtacaggaactcgaccaacccggccctacaaactatttacacgagacgtacttttaccacctaccgaagaacaaaacaaaacttaacacgtccctactctacgaccctattacctcgttactccacgcctagaccgacgacggctacgactactactgccgtacgacgtccgtcgggaccaccacgccgtcgtcgtcgtccgttcgggtaccgttttcggggccggtaacgggacccgtaaacggccgttacgggtaaccccgttccggttcggggttacctaaccgggaccccgaacgggtcccgtaccggttcccccgttccggttccctaaccccg

SEQ ID NO: 432310 - DNA, 619 bp, Homo sapiens
  misc_feature: GZ8MTXP01D7LMM.19.85.H08.1.454.CMB.2.raw
  modified_base (260)..(260): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgctggcngcagcaacgccaggcccaccctccaaactcctgtcgacaggaatcgaacaacccggccctacaaaactactttacaagaacgtaagtactttttacaaccctaccaaggaaaaccaaaccaaaatacaacgacccttactactagaaccctattactggtctccagcctagacgacgaggctgaactactactgctacagccgtcgggacacccagcccgtcgcctgtcgttcggtcgttttccgggcgggaacgggaacccgttaaaggcccgttcggaaccccggttccgttacgggggttcccaacgggaaccccgaaacggggccttaccggtcccccccgttcgggtttccccg

SEQ ID NO: 432311 - DNA, 553 bp, Homo sapiens
  misc_feature: GZ8MTXP01BOQ92.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacccgtcggtggtccggggcctgggacaggccgccacagtcacctgcaccgggaacacaacaatgtcggcgaccagggacgccgcttggctgcagcaacgccacgggccaccctccaaactcctgtcgtacaggaatcgacaacccggccctacaaactattcagagacgtacttttcacctcaggaacaacaaatcaacgcctctctgacctattactgtcctacacgcctgacgacgagctgactactactcgctcacgccgtcgggaccaccgacgcctcgctcgcgttcggccgtttcgggcggttagggacccaagccgtcgaccgttccgttgggtccgacggcccgaacggtccttccggtccccgttcggtccc

SEQ ID NO: 432312 - DNA, 749 bp, Homo sapiens
  misc_feature: GZ8MTXP01DXQ0U.19.85.H08.1.454.CMB.2.raw
  modified_base (249)..(249): a, c, t, g, unknown or other
  modified_base (254)..(254): a, c, t, g, unknown or other
  modified_base (259)..(259): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccacccgtcggtcggtccgggggcctgggacaggccgccacagtcacctgcaccggaacacaacatgcggcgacgaggngccgntggcngcagcaacgccgacgggccccacccctcccaaactcctgtaccgtacaaggaactcgaaccaacccggccctaacaaactactttacgaagtaagtaacgttacttttacctaccctccgaaggaaacccaaactaaactacgacgtacccttactaccgtacgaaaccttatttaccgtacggttaccttacccgacgtcccgttaacggaacccggaaccggtaacgggccttaacggaacccttacctaaccgttcggaccttaccgaacggtcccgtacggggacccaaccccgtacgcccgttcgtccgttcggtccgtttccgggtccgttttccggggaccggggttaaccggggaacccgttaaacgggtcccgttaccgggttaccccggtttccggttaccgggggttcccgaacccggtccccggtaaacccgggtccccgttaccccggtcccccccggtttccgggtttaacccccg

SEQ ID NO: 432313 - DNA, 579 bp, Homo sapiens
  misc_feature: GZ8MTXP01AL628.19.85.H08.1.454.CMB.2.raw
  modified_base (326)..(326): a, c, t, g, unknown or other
  modified_base (366)..(366): a, c, t, g, unknown or other
  modified_base (418)..(418): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccaggggagccgcttggctgcagcaacgccagggcccaccctccaaactcctgtcgtacaggaatgacaaccggccctacaaacnttcagagagtactttcactccagacaaacaaatcagcctntctagacctattactcgtctccacgcctgacgacgaggctcgactacgtacncgctacgacgccgtgggaccaccacgccctcgctcgtcgttcggtccgtttcggggcgggtacgggaccgtaaacggcgtcggtaacccggttccgttcggggttaccgaaccggaccccgaacgggtcccgtccggttcccccgttcggttccttccccg

SEQ ID NO: 432314 - DNA, 520 bp, Homo sapiens
  misc_feature: GZ8MTXP01CBOCH.19.85.H08.1.454.CMB.2.raw
  modified_base (435)..(435): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccacccctcccaaactccctgtccgtacaggaatgaccaaccggccctcaaacatttcagagagacttttcactccagacaacaaatcagcctctctgaccattactgtctccagcctgacgacgagctgactactactgctcgagccgtgggaccaccgngcctcgctgtcttggtctttcggcggtggaccagcgtgaccgttccgttggttccaagcccaaggcctcgcccctcggttctccg

SEQ ID NO: 432315 - DNA, 549 bp, Homo sapiens
  misc_feature: GZ8MTXP01BX190.19.85.H08.1.454.CMB.2.raw
  modified_base (230)..(230): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggaacaccaanaatgtcgcgaccagggagccgcttggctgcagcaacgccagggcccacccctcccaaactcctgtcgtacaggaatgaccaaccggccctcaaaccatttcagagagtactttcactcaggacaaacaaatcagcctctctgaccattactgtctccagcctgacgacgaggctgactactactagcctcgacgcctgggaccaccgacgcctcgctcgtcgttcggtccgtttcgggcggtacgggacctaacgcgtcgacccgttccgttcgggttccaacggtcccgaacggcctcgcccccgtcggttcctcccg

SEQ ID NO: 432316 - DNA, 526 bp, Homo sapiens
  misc_feature: GZ8MTXP01DI6ST.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctactgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccacccctcccaaactccctgtcgtacaggaatgacaaccggccctcaaacatttcagagagtacttttctactccaggacaaacaaaatcagcctctctgaccattactgtctccagcctgacgacgaggctgactactactgcctcgacgccgtgggacaccacgcctcgctgtcttggctttcggcggtaggaccaagcgtcgacgttccgttgggttcaagcccaaggctcgcccctcggttctccg

SEQ ID NO: 432317 - DNA, 577 bp, Homo sapiens
  misc_feature: GZ8MTXP01COPCG.19.85.H08.1.454.CMB.2.raw
  modified_base (340)..(340): a, c, t, g, unknown or other
  modified_base (349)..(349): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccgggggcctgggacaggccgcacagtcacctgccaccggaacaccaacaagtcgcggacgaccgagggacgccgcgtggctgcagcaacgccgacggcccaccctaccaaactcctgtcgtacgagaatcgaaccaaccggccctaacaaactnttacaaganagtacctttcactcaagacaaaacaaaatcacgtcctactactacgacctattactcgtcctacacgctacgacgacgacggctacgactactactcgctcgacgccgtcggaccaccgacgcctcgtcctcgtccgttcggtcgtttcgggcgggtaacggacgtacgcgtacgccgttcgcggttaccgaacgacccgaacggcctccgccccgtcggttcctccg

SEQ ID NO: 432318 - DNA, 605 bp, Homo sapiens
  misc_feature: GZ8MTXP01BHVFM.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctggaggtccctgagagtctcctgcacagcctctggattcaccttcagtaactatgagatggactggatccgcaggctcgaggaagggctggagtggattgcctatgtcactaggtgaggcgaagtcacgtcctacgcggactcgtgtcggccggggtccgtttaccatcctaccgagagacaagtcgaccaaagagacgtcttacgtttctggtactaagtttcggaccggtccgttggacgtacggtacggaaacgtaccgacggtcctttaatttaactttacgttgttggttaggaagggtaggggacgggggttcaccgggtgggtcggttcggggttccggggttcgttacgtttccggtttttgttaaggg

SEQ ID NO: 432319 - DNA, 723 bp, Homo sapiens
  misc_feature: GZ8MTXP01CR1YM.19.85.H08.1.454.CMB.2.raw
  modified_base (272)..(272): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacccgtcggtcggtccgggggcctgggacacggccgccacagtccacctgaccgaccgggaacaccaacaatgtcggacgaccgagggacgccgcttggcngcagcaacgccgacgggccccacccgtcccaaactcctagtaccgtacaagggaactcggaaccaaaccccgggcccctaacaaaacgtactttaccaagtaacgtaaccgttactttttaccaccctacccgaaggaaacccaaactaaactaccaacgtacccttactacctacgaaccctaactttaccgtcggtaccttaccgagacccttaggaaccgtacggacgtacctacggaacctactaacgtcgacgttccgaacggtccgtacgggaaccaacccgcgtccccttcggccgttcggtccgtttccgggttccggttttcgggggaccggggttacggggaacccaaaggtccgttacgggaccccggttccggttaccggggtaaccaaccggtcccgaacgggtcccttcccggtaaccccccgttcgggttaacccc

SEQ ID NO: 432320 - DNA, 532 bp, Homo sapiens
  misc_feature: GZ8MTXP01DP56M.19.85.H08.1.454.CMB.2.raw
  modified_base (491)..(491): a, c, t, g, unknown or other
  modified_base (504)..(504): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtggggaggcttggttcagcctggagggtccctgagagtctcctgcacagcctctggattcaccttcagtaactatgagatggactggatccgcaggctccaggaaagggctggagtggattgcctatgtcactagtgagggcaagtcacgtcctacgcggactctgtcggcggggtccgtttacgatctccagagacaaatgaccaagaagacgctcttactggactaagttgacggccgtgagagtacgaaagacgacggtctatttaatacttgtgttgagnggagggggcacgnggcgtggtcgggtgttatcgtttgtaag

SEQ ID NO: 432321 - DNA, 551 bp, Homo sapiens
  misc_feature: GZ8MTXP01DLQS7.19.85.H08.1.454.CMB.2.raw
  modified_base (324)..(324): a, c, t, g, unknown or other
  modified_base (332)..(332): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctccaaactcctgtctacaggaatgacaaccggccctacaaacntttcaganagtactttcactcagacaaacaaatcagcctctctagacctatactgtctccagcctgacgacgaggctgactactactcgctcgacgccgtagggacacccgagcccgtcgcctgtcttcgggtccgttttcgggccggtagggaccaaggccgtcggaccgttccgttcgggttaccaacggacccaaggcctccgcccctccgggttcctaacccg

SEQ ID NO: 432322 - DNA, 594 bp, Homo sapiens
  misc_feature: GZ8MTXP01A6VPG.19.85.H08.1.454.CMB.2.raw
  modified_base (248)..(248): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacctcggtgtccggggcctgggacaggccgccacagtcacctgcaccgggaacaccaacaatgtcggcgaccaggganccgcttggctgcagcaacgcagggccacccctccaaactcctgtcgtacaggaactgacaaccggccctacaaactattccagacgagtactttaccactccaaggacaaaacaaaagtcacgtcctactctacgacctattacctggtcctcacgtcctagacgacgacgctacgactactactcgctcgacgccgtacgggaccaccgacgcccgtcgcctcgtccgttcggtccgttttccgggcgggttaacggggaccgaaacgttccgtacggtaacccggttccgttcgggttccgaacggcccgtaacggccgtccgccccgtcggttccgtaacccg

SEQ ID NO: 432323 - DNA, 586 bp, Homo sapiens
  misc_feature: GZ8MTXP01DCO8Q.19.85.H08.1.454.CMB.2.raw
  modified_base (325)..(325): a, c, t, g, unknown or other
tcagtactctcgtgcacgaccggtgctcgatttagtatcactcagtcgcggggtccaaacagagcttcagcaagcatagtgggaatctgcaccatgcccctgggctctgctcctcctgaccctcctcactcactctgcagtgtcagtggtccaggcaggactgactcagccaccctcggtgtccggggcctgggacaggccgcacagtcacctgcaccgggaacaccaacaatgtcggcgaccagggagccgcttggctgcagcaacgccacgggcccacccctccaaactcctgtccgtacaggaatcgaccaaccggccctanaaactatttcagagacgtactttcacctcaaggacaaacaaaatcacgtccctactctacgtaacctattacctcgtcctaccacgcctacgaacgacgacggtctacgactactactgacctcgacgccgtacgggaccaccacgtccctcgtctcgtccttcggtccgtttcgggaacgggtacggaccgaacgcgtcgtaccgttcgttcggttcgaacggacccgaaggtcccgtcgccccgtcggttcctaacccg

SEQ ID NO: 432324 - DNA, 549 bp, Homo sapiens
  misc_feature: GZ8MTXP01BN2R5.19.85.H08.1.454.CMB.2.raw
  modified_base (441)..(441): a, c, t, g, unknown or other
  modified_base (462)..(462): a, c, t, g, unknown or other
  modified_base (484)..(484): a, c, t, g, unknown or other
  modified_base (506)..(506): a, c, t, g, unknown or other
  modified_base (536)..(536): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagcttggttcagcctggagggtccctgagagtctcctgcacagcctctggattcaccttcagtaactatgagatggactggatcccgccaggcctccgaagggaaagggctggagtggattgcctatgtcacgtagtgagggcaagtccacgtcctacgcgggactcgtggtcgggcggggtccgttacgatacgtcgagagacgatcgacaagacgacgctctttcngggactaagttcggacggtcngagagtaccgaagacgaccgtntatttaatattggtgttgaggngggaggggcacgtggcgtgggtcggtgttnttcgtttgtaagg

SEQ ID NO: 432325 - DNA, 587 bp, Homo sapiens
  misc_feature: GZ8MTXP01BBPKE.19.85.H08.1.454.CMB.2.raw
  modified_base (254)..(254): a, c, t, g, unknown or other
  modified_base (258)..(258): a, c, t, g, unknown or other
  modified_base (263)..(263): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccacccgtcggtggtccgggggcctgggacagggccgccacagtcacctgccaccggaacaccaacaatgcggcgaccaggganccgntggcngcagcacgccacgggcccacccctccaaactcctgtcgtacaggaatcgaccaacccggccctacgaaactatttacagagacgtacttttcacctaccaggaaacaacaaatacacgcctctctacgactattactgtctccagcctagacgacgacggctacgactactactcggctcgacgtccgtcgggaccacccgacgccctcgctcggtcgttcggtcgtttcgggcgggacgggtaccaacggtcgtcggacccggttccgttcgggtccaccggtcccgaacgggtccttcccggtcccccgttcgggtaacccc

SEQ ID NO: 432326 - DNA, 575 bp, Homo sapiens
  misc_feature: GZ8MTXP01DX6TW.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagcccaccctcggtgtccgggggcctgggacaggccgccacagtcacctgcaccggaacaccaacaatgtcgcgaccgagggagccgcttggctgcagcaacgccacgggcccaccctcccaaactcctgtcgtacaggaatgacaccggccctacaaactattcagagagtactttcactcagacaaacaaatcagcctactctagaccattactgtctccagcctgacgacgagctagactactactcgcctaggacgccgtacgggaaccaccgacgccctcgtactcgtcgttcgggtccgtttcggggaacggtaacggggaccaaacggccgtacggacccgttaccgttagttccgaacggacccaagggtccctcggcccccgttcggttccgttaacccg

SEQ ID NO: 432327 - DNA, 536 bp, Homo sapiens
  misc_feature: GZ8MTXP01CSDEW.19.85.H08.1.454.CMB.2.raw
  modified_base (228)..(228): a, c, t, g, unknown or other
  modified_base (246)..(246): a, c, t, g, unknown or other
  modified_base (250)..(250): a, c, t, g, unknown or other
  modified_base (255)..(255): a, c, t, g, unknown or other
  modified_base (285)..(285): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacctcggtgtccggggctgggacaggccgccacagtcacctgcaccggaacaccaanaatgtcggcgaccagganccgntggcngcagcaacgccaggccacctccaaactccngctacagaatcgacaaccgccctacaaacattacagagtacgtatttacacctccaagaaccaaacaaactacagaccctactactacgaacctattactcggtacctacacgcctagacgacgagctacgactactactcgctacacgactcgggacaccgacgcctcgctcgtcttcggcgtttcggcggacggaccaagcgtcgaccgttcgacgggtcacgccgacggcttccgccccgttcgtccg

SEQ ID NO: 432328 - DNA, 647 bp, Homo sapiens
  misc_feature: GZ8MTXP01DQ8QN.19.85.H08.1.454.CMB.2.raw
  modified_base (241)..(241): a, c, t, g, unknown or other
  modified_base (601)..(601): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctggggacaggccgcacagtcacctgcaccggaacacaacaatgcggcgaccngggagccgctggctgcagcaacgccacgggcccaccctccaaactcctgtcgtacaggaactcgaaccaacccggcccctacaaacctatttaccaagagtacgtacttttccaacctaccgaggaaccaaaacaaaatcaacgtccctactctacgaaccctatttaacctcggtcctaccgacgcctagaccgaacgacggtctaacggtactactaacctggtcctacgtacgacccgttacggggaaccaacccgacgtcccgtcggccttcggtccgtttcgggtccgttttcggggaacgggtaacgggacctaaaggttccgtacggtcccggttaccgttcggggttacccncggacccgaacgtcccgtcccgttccccgtcggttcccttaacccg

SEQ ID NO: 432329 - DNA, 610 bp, Homo sapiens
  misc_feature: GZ8MTXP01CAOIH.19.85.H08.1.454.CMB.2.raw
  modified_base (205)..(205): a, c, t, g, unknown or other
  modified_base (227)..(227): a, c, t, g, unknown or other
  modified_base (341)..(341): a, c, t, g, unknown or other
  modified_base (411)..(411): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacctcggtgtccgggggcctgggacaggccgcacngtcacctgcaccggaacacaanatgtcgcgacagggagccgctggctgcagcaacgccagggcccaccctcccaaactcctgtcgtacaggaatgaccaacccggccctacaaacattcagagagtacctttcacnctagacaaacaaatcacgcctactcacgacctattactgtcctcagcctgacgacgaggctgactctacngctcgacgtccgtacgggacctaacccgacgtccctcgtccgtcggtcccgtttgggttacccgttttcgggggaaccgggtaacgggacccgtaaacggccgttacgggaaccccgttcccggttacgggggttcccgaaccggccccggtaacggcccgttcccgggcccccgttaacggggttcccttaaccccgg

SEQ ID NO: 432330 - DNA, 571 bp, Homo sapiens
  misc_feature: GZ8MTXP01D5143.19.85.H08.1.454.CMB.2.raw
  modified_base (228)..(228): a, c, t, g, unknown or other
  modified_base (329)..(329): a, c, t, g, unknown or other
  modified_base (358)..(358): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccggaacacaanatgcgcgaccaggagccgctggctgcagcaacgccaggcccacccctccaaactcctgtacgtacaggaatcgaccaaccggccctacaaactattcaganagtactttcactcagacaaacaaaatcancctctctacgaccattactgtctcagctagacgacgagctagactactactcgctcgacgccgtggacaccacgcctcgtcctgtccgttcggtcgtttccgggaacgggtacgggaccgaaacggttccgtaccggtaacccggttccgttcgggttacccgaacgccccgaacggtcccgtccgttcccccgtcggttcccgttaaccccg

SEQ ID NO: 432331 - DNA, 528 bp, Homo sapiens
  misc_feature: GZ8MTXP01BRRV1.19.85.H08.1.454.CMB.2.raw
  modified_base (490)..(490): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctggagggtccctgagagtctcctgcacagcctctggattcaccttcagtaactatgagatggactggatccgcaggctccaggaaagggctggagtggattgcctatgtcactagtgaggcgaagtcacgtccacgcggactcgtgtggcggggtccgttaccatctccagagacaatgaccaagaagacgctactttctggctaagttcggacggcctgagagtacgaagacgacggtctagttaattacttgtgttgagnggagggggcagtgcgtggtcgggtcgattgtttgtaag

SEQ ID NO: 432332 - DNA, 555 bp, Homo sapiens
  misc_feature: GZ8MTXP01DG6DD.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccggaacaccaacaatgcggcgaccagggagccgcttggctgcagcaacgccagggcccacccctccaaactcctgtcgtacaggaactgacaaccggccctacaaacatttcagagagtactttcacctcaagacaaacaaaatcagcctactctacgacattactgtctccagcctgacgacgaggctcgactactactcgcctcgacgcctacgggaccaccgacgccgtcgctcgtcgttcggtccttttcgggcggtacgggacctaaggcgtcggacccgttcgttcgggttccaacgacccgaacggcctccgccccgtcggttctaacccg

SEQ ID NO: 432333 - DNA, 639 bp, Homo sapiens
  misc_feature: GZ8MTXP01C23HL.19.85.H08.1.454.CMB.2.raw
  modified_base (259)..(259): a, c, t, g, unknown or other
  modified_base (294)..(294): a, c, t, g, unknown or other
  modified_base (323)..(323): a, c, t, g, unknown or other
  modified_base (329)..(329): a, c, t, g, unknown or other
  modified_base (337)..(337): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtggtccgggggcctgggacaggccgcacagtcacctgcaaccgggaacaccaacaagtcgtcgacgaccgagggagccgnttggctgcagcacgcaggcccaccctccaactccngtacgtacaggaatcgaacaccgccctanaaactnttacaganacgtactttcactcagacaaacaaatcagtcctacgtactacgaacctattacgtaggttaccctaccgaacgtcccgtaggaaccggtaaccggacgggtccttacggaaccttaaaccttaacgttcgacccgttacgacggtacccgtacggggaacccacccgtacgccctcgccgtgtccggttcggtccgtttcgggaacgggtacgggacctaacggccgttacgaccccgggttgcgggttaccgaacggtccccgaaggtccctccggttccccctcgggttcccgtaacccg

SEQ ID NO: 432334 - DNA, 558 bp, Homo sapiens
  misc_feature: GZ8MTXP01B1Q6J.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccacaatgtcggcgaccagggagccgctggctgcagcaacgccagggccacccctcccaaactcctgtcgtacaggaatgacaaccggccctcaaacatttcagagagtacttttcctacctccaaggaccaaacaaaatcagccctactctgaccatttacctggtctccacgcctgacgacgagctcgactactactagctcgagcctgggaccaccacgcctcgctcgtcgttcggccttttcgggcggtacgggacccgaaggcgtcgaccgttccgttcgggttccaacggcccgaacggccgtccgccccctccgggttctaacccg

SEQ ID NO: 432335 - DNA, 564 bp, Homo sapiens
  misc_feature: GZ8MTXP01C8HIS.19.85.H08.1.454.CMB.2.raw
  modified_base (229)..(229): a, c, t, g, unknown or other
  modified_base (250)..(250): a, c, t, g, unknown or other
  modified_base (327)..(327): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccggaacaccaanaatgcgcgaccagggagccgntggctgcagcaacgccagggccacccctccaaactcctgctacaggaatgacaaccggccctacaaactatttcagngagtacttttcactcaagacaaacaaaatcagcctactctagaaccctattaactgtctaccacgcctgaacgacgaggctagacctactactgcctcgacgccgtcgggaccaccacgccgtcgctcgtcttggtccgttttcgggaacggtacgggaccgtaaagcgtcgaccgttccgttcgggttacaacggacccgaacgggcctccggttccccgtcggttcgttaacccg

SEQ ID NO: 432336 - DNA, 800 bp, Homo sapiens
  misc_feature: GZ8MTXP01DBZTV.19.85.H08.1.454.CMB.2.raw
  modified_base (252)..(252): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtggtccgggggcctggggacaggccgccacagtcacctgccaaccggaacacaacaatgcgcgaccagggacnccgctggctgcagcaacgccagggccccaccccgtccaaactcctgtaccgtacaggaatcgaccaaccggcccctacgaaactattacagagacgtactttccactcgtaagaccaaaacgtaaaactcgacgtaccctaccttacgtacgtaacctaacgttacctacggttacctacccgtaacggtacccgttacgggtaaacccggaaacgggtaaccggtaccgttaacgggtaacccttaaaccgtaacctttaacggcccttaccgggtaacccggtacccgggtttaacccgggggaacccaaccccgaaccggtaccccgtttaccggtacccgttacccgggttcccggttttaccgggttcccgggttttttccgggggaacccgggggttaacggggaaccccgtaaacggttccggtttaaccgggaaccccggttaccggtttcccgggggttaccgtaacccgggaacccggttaacccgggaccccggtcccggttacccccggttccccggttaacccggtttaaccccg

SEQ ID NO: 432337 - DNA, 605 bp, Homo sapiens
  misc_feature: GZ8MTXP01DPTKN.19.85.H08.1.454.CMB.2.raw
  modified_base (257)..(257): a, c, t, g, unknown or other
  modified_base (266)..(266): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacccgtcgggtcggtccggggggcctggggacacggccgccacagtcacctgcaccggaacaccaacaatgcggcgaccgaggganccgctggcngcagcaacgccaggcccaccctccaaactcctgcgtacaggaactcgaaccaacccggccctacaaactactttacagagtacgtacttttcaaccctccaacggaaacaaacaaactcaacgccctactactacgaacctacttactgtcctaccgacgcctagaaccgacgacggctacgactactaacgtcgacctacgacgtccgtacgggaccaccgacgcctcgctcgtcgttcggtcgtttcgggcggttacgggaccaacggtcgtcgaccgttccgttcgggtaaccacggaacccgtaacggccgttaccgtccccgttaacggtcccg

SEQ ID NO: 432338 - DNA, 568 bp, Homo sapiens
  misc_feature: GZ8MTXP01CTD4E.19.85.H08.1.454.CMB.2.raw
  modified_base (321)..(321): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacctcggtgtccggggctgggacaggccgcacagtcacctgcaccggaacacaacatgcgcgaccagggagccgcttggctgcagcaacgccagggcccacccctccaaactccctgtcgtacaggaatcgacaaccggccctacaaactntttcagagagtactttacacctcagacaaacaaatcagccctctctgacctattactgtctccagcctgacgacgagctgactactactgcctcgacgccgtacgggaccaccgacgtcctcgtcctcgtccgttcggtccgtttcggggcggacgggacctaacggcgtacggacccgttccgttcgggttacaaccggtacccgaacggtcccgtccggttacccccgtcggttcccgtaacccg

SEQ ID NO: 432339 - DNA, 587 bp, Homo sapiens
  misc_feature: GZ8MTXP01EGW71.19.85.H08.1.454.CMB.2.raw
tcagtactctcgtgcacgaccggtgctcgatttagtatcactcagtcgcggggtcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagcttggttcagcctgggaggtccctgagagtctcctgcacagcctctggattcaccttcagtaactatgagatggactggactccgccaggcctacgagggaaagggctggagtggattgcctagtgtacacgtaggtggaggggcgaagtccaaaccggttcctaacggcgtacctcgtggtcggccgggggtccgttttaccactctccagagacaagtacgaccaagacgacgctactttctgacgtaagttcggacgccgtagagagtacgaacgacgtacggtacttatttagtaacgtgttaggtggttaggagggacgggggcacggttggcgtgggtcgggtcgtagttcgtttgttaagtttgggg

SEQ ID NO: 432340 - DNA, 584 bp, Homo sapiens
  misc_feature: GZ8MTXP01B19JM.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacccgtcggtcggtccgggggcctgggacaggccgccacagtcacctgcaccggaacacaacatgcggcgaccgagggagccgctggctgcagcaacgccacggccaccctcccaaactcctgtcgtacaggaatcgaccaacccggccctacaaacatttacagagtacgtacttttcaaccctccaaggaaaccaacaaatacacgtccctctactacgacctacttactgtcctccagtccctgaaccgacgaggctagacctactactcgctcagccgtgggaaccaccgacgccgtcgctcgtcgtttcggtcgttttcgggcgggttacgggaccaaggtcgtacggttaccgttccgttacgggtccacgtcccgtaacggtcccttccccgtcggttaactcccg

SEQ ID NO: 432341 - DNA, 517 bp, Homo sapiens
  misc_feature: GZ8MTXP01DRR0H.19.85.H08.1.454.CMB.2.raw
  modified_base (369)..(369): a, c, t, g, unknown or other
  modified_base (472)..(472): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgcggcgaccagggagccgcttggctgcagcaacgccagggcccaccctcccaaactcctgtccgtacaggaatcgacaaccggccctacaaacatttcagagagtactttcactcaggacaacaaaatcagcctntctgaccattactgtctcagcctgacgacgacgctgactactactgctcgacgccgtgggaccaccacgcctcgctgtcttggctttcggcggaggacagcgngtcgttcgttcggttcaagccgaacgctcgcccctcggttctccg

SEQ ID NO: 432342 - DNA, 591 bp, Homo sapiens
  misc_feature: GZ8MTXP01BX8A3.19.85.H08.1.454.CMB.2.raw
  modified_base (227)..(227): a, c, t, g, unknown or other
  modified_base (244)..(244): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggctgggacaggccgccacagtcacctgcaccggaacacaanatgcgcgacaggagcgntgctgcagcaacgccagggcccacccctaccaactcctcgtacgtacgagatacgaccacccggcccacaaactattacagagatactttacacctcacgacaaaacaaactcacgtcctactctacgacctattactacgtctaccacgtcctacggaaccgaacgacggtctacgaacctactactcgccttacggaacgtcccggtacgggaccaccctacgcctccgcgtcgtcgttcggtccgtttcgggcgggtaacggacacggttcgtaccggaccgttccggttcggttcgaaccggtacccgaacggtccgtccgttccccgtcggttcctaacccg

SEQ ID NO: 432343 - DNA, 543 bp, Homo sapiens
  misc_feature: GZ8MTXP01CBIXO.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggcccaccctcccaaactcctgtcgtacaggaatgacaaccggccctacaaacatttcagagacgtatttcacctcaagtaacaacaaatacagccctctctagacctattactgtctcacgcctagacgacgaggcagactactactgctcacgccgtcggacaccgacgcctcgctgtcgttgtcgtttcggcggacgggacccaagccgtcgacccgttccgttcgggtcacgcccgaacggccttccggtcccccgttcggtcccg

SEQ ID NO: 432344 - DNA, 673 bp, Homo sapiens
  misc_feature: GZ8MTXP01ELH6A.19.85.H08.1.454.CMB.2.raw
  modified_base (231)..(231): a, c, t, g, unknown or other
  modified_base (253)..(253): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtggtcggtccggggcctgggacacggccgcacagtcacctgacaccggaacacaanaatcgcgcgacgagggagccgntggctgcagcaacgccacggcccaccccaccaaactccgtgtaccgtacgaaggaactacgaccgaaccggccctaacaaactatttcgaagagtacgtaacttttccacctacaagaccaaaacaaaatccgacgtacctactacgtacgaaccctattaccgtacgtacctacccgaacgtcccgttaggaaccggaacgagggtaccctacggtaaccttacctaacgtcgtacccttaccgggaacggtcccggtaggaacccgacccagtcccgtcgcgttcgtccggtttcggtaccgtttccgggaacgggtaacggacccgtaaacggttccgtaccggtaaccgttccggttcgggttccaacggacccgaacggggtccctcccggttcccccgttcgttcccgttcccg

SEQ ID NO: 432345 - DNA, 665 bp, Homo sapiens
  misc_feature: GZ8MTXP01BUAU9.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccggggcctgggacacggccgccacagtcaccgtgccaccgggaacaccaacaatcggcggcgaccgagggacgccgcgtggctgcagcaacgccgacggcccacccctaccaaactcctacgtaccgtaacaggaactacgaaccaaccccggtaccctaacgaaaacctactttacgaacgtacgtacgttaccttttacctaacctaccgaacggaaccaaaaacaaaactcaacgtccctacctactacgaacctattaccgtcgtacctaccaacgtccgtacggaacgacgacgggtactacgaaccttacgtacgtacgtacctcggtaacgtccgtacgggaccaccgacgtcccgtcgtcctcgtccgttcggtccgtttcgggaacggtacgggacctacggcgtacgtacccggttcgttcgggttacaaccggccgaacggtccgtcccgccccgtcggttcctcccg

SEQ ID NO: 432346 - DNA, 564 bp, Homo sapiens
  misc_feature: GZ8MTXP01BF26R.19.85.H08.1.454.CMB.2.raw
  modified_base (314)..(314): a, c, t, g, unknown or other
  modified_base (326)..(326): a, c, t, g, unknown or other
  modified_base (354)..(354): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccggaacaccaacaatgcggcgaccagggagccgctggctgcagcaacgccagggccaccctccaactcctgcgtacaggaatcgacaccggccctanaaacattcaganagtactttcactcagacaaacaaatcancctactctgaccattactgtactcacgcctgacgacgacggctcgactactactgtctacgacgccgtcgggacctaccacgcctcgctcgtcgttcggtccgtttcgggcggtacgggaccgtaacgccgtacggtacccggttcgttcgggttaccgtaaccggcccgaacggtcccgtacccgttccccgtccggttccgtaacccg

SEQ ID NO: 432347 - DNA, 594 bp, Homo sapiens
  misc_feature: GZ8MTXP01DOGLS.19.85.H08.1.454.CMB.2.raw
  modified_base (277)..(277): a, c, t, g, unknown or other
  modified_base (419)..(419): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgcttgggttttccttgtcgctattttagcaggtgtccaatgtgaggtggagttggtggagtcgtgggggaggcttggttcagccgtggagggtccctgagagtctcctgcacacgcctctggattcaccttnagtaactatgagatggactggactcccgccgaggctaccgagggaaaggggctgggagtggattgcctatgtcacctaggtgagggcaagtcacgtccgtacgcgactcgtggtcggcggggtccgttacatcctacagganaacaagtcgacaaagaacgacgcttcttcgtggtactaagttcggaccggtcctaggagacgtacggaagtacgacggtcttaatttaacttacgttgttggttgaagggtgggacgggggcttacggtgggtcggtgggttacggggtcgttacgtttcgttttggttaacggg

SEQ ID NO: 432348 - DNA, 572 bp, Homo sapiens
  misc_feature: GZ8MTXP01C8MNS.19.85.H08.1.454.CMB.2.raw
  modified_base (233)..(233): a, c, t, g, unknown or other
  modified_base (245)..(245): a, c, t, g, unknown or other
  modified_base (252)..(252): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgccaccctcgggtcgtccgggggcctgggacaggccgccacagtcacctgcacggacacaacangcgcgacaggancgctgcngcagcaacgccgacgggccccaccctacccaaactcctgtacgtaacgaggaactcgaaccaacccggccctacaaacatttcagagacgtatttcgacctacagaaacaacaaatacacgtcctactcacgtactattactcgtctccgagcctagacgacgagactacgactactactcgactacacgcctacgggaccaccgacgcctcggctcggtcttcgggtcggtttccggcgggacggaccaaggtccgtcggttacccgttcgttcggccacggcccgaacgggccttcccggtccccgttcggtaacccg

SEQ ID NO: 432349 - DNA, 646 bp, Homo sapiens
  misc_feature: GZ8MTXP01C84EI.19.85.H08.1.454.CMB.2.raw
  modified_base (259)..(259): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgccaccggaacaccaacatgtcggcgaccagggagccgctggcngcagcaacgccgaggcccaccctcccaaactcctcgtcgtacaggaatcgaaccaacccggccctacaaactactttacagacgtacgtacttttaccaccctccaaggaaaccaaacaaataccaacgtcccttctacctacggaaccctaatttaccgtcggttacctaccgacgccgttacgaccgacggacggtactacgaacctactaactcgtacttacgacggtcccgtcggggaccaacccgacgtccgtcgccgttcggtcgttcgggttccgttttcggggcgggttacgggacccgttaacggtccgtcggacccggttccgttacggggtccacggcccgtaacggccgttcccgtcccccgttccgggtccccg

SEQ ID NO: 432350 - DNA, 587 bp, Homo sapiens
  misc_feature: GZ8MTXP01D7204.19.85.H08.1.454.CMB.2.raw
  modified_base (430)..(430): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctggggacaggccgccacagtcacctgcaccgggaacacaacaatgcgcgaccagggagccgctggctgcagcaacgccagggcccaccctcccaaactcctgtcgtacaggaaactcgaaccaacccggaccctacaaacctatttacaagagagtactttccactcagaacaaacaaaatcaagcctctctacgactattactgtctccagcctgacgacgacgtctagactactaacncgtactcaacgtccgtagggacaccgacgcctcgtcctgtcgttcggtctttcgggcggtaacgggacctaaacggcgtccggaaccgttccgttcgggttaccgaaccggcccgaacggtcccgtaccggttcccccgtccgggttcctaaccccg

SEQ ID NO: 432351 - DNA, 632 bp, Homo sapiens
  misc_feature: GZ8MTXP01BLRF8.19.85.H08.1.454.CMB.2.raw
  modified_base (253)..(253): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtgtccggggcctgggacaggccgccacagtcacctgcgaccggaacaccaacaatcgtcggcgaccgaggganccgcttggctgcagcaacgccacgggcccacccgtacccaaactcctagtaccgtaacaggaaactcggaaccaacccggcccctacaaacctactttaccaagtagtacgttacttttacctaaccgtccaaggaacctaaaacaaaaacttccacgtcccttacctactacgaacctaattaccgtcggttacctaccgacgccttacggaacggacgacggctacgacttactactgtccttcgacgtccgtacgggacaccgacgcccgtcgctcgtcgttcggtcgtttcgggcggtacggaccgacgttcgtcgtaccgttccgttcggttacgaacgcccgaacgtccgtccgcccgtccggttctaacccg

SEQ ID NO: 432352 - DNA, 633 bp, Homo sapiens
  misc_feature: GZ8MTXP01BGTQU.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcgggtcggtccgggggcctggggacacggccgccacagtcacctgccaaccgggaacaccaacaagtcgtcggcgaccgagggagccgcttggctgcagcaacgccgacggcccacccctacccaactccgtgtacgtacacggaatcgaccaccggccctacaaactattacgagacgagtacctttcactacacgacaaacaaatcacgcctctactacgactacttactcgtactaccgagcctgacgacgacggctacgactactactgactacgacgtacgtacgggaccaccgacgtcccgtcgtacgtcggtcgtttcggttccggtttcgggaacgggtacgggttacccgtaacggttccggtaccggtaccggttccggttcgggttaccgcccggtacccggtaacgggtccctcccggttacccccgtcggttcccttaaccccg

SEQ ID NO: 432353 - DNA, 622 bp, Homo sapiens
  misc_feature: GZ8MTXP01C4RB0.19.85.H08.1.454.CMB.2.raw
  modified_base (280)..(280): a, c, t, g, unknown or other
  modified_base (443)..(443): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcgacgcccacccgtcgggtcggtcccggggggcctgggacacgggccgccacagtcacctgccgaaccggaacaccaacaagtcggacggcgaccgagggacgccgcgttggcngcagcaacgccgacggcccaccccgtcccaaactcctacgtacgtacgaggaactcgaaccaacccggaccctacaaactattacagtagtacttactttacacctaccaggtaaaccaaacaaactacacgtaccctctactacgacctaattacctgtccnccagcctgacgagagctacgactactactcgctcacgccgtagggaccaccgacgcccgttcgccgtcgtcgttacggtccgtttcgggcgggttacgggaccacgtccgtacggttacccgttcggttacgggccaccggtccacgggtccttacccggtccccgttccgggtaaccc

SEQ ID NO: 432354 - DNA, 587 bp, Homo sapiens
  misc_feature: GZ8MTXP01EX0B0.19.85.H08.1.454.CMB.2.raw
  modified_base (247)..(247): a, c, t, g, unknown or other
  modified_base (257)..(257): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacctcggtgtccgggggcctgggacaggccgccacagtcacctgcaccggacaccaacaatgtcggcaccaggganccgcttggcngcagcaacgccagggccaccctccaaactcctgtcgtacaggaatgacaaccgggccctacaaacatttcagacgtacgattttcacctcaggaaacacaaactcagcctctctcgacctattactgtctaccagcctagacgacgaggctagactactactgactcagcctgggacacccgagcccttcgctcgtcgttcggtccgttttaacgggccgggttaacgggacccgttaaaggtccgtcggaaccccggttccgttacgggggttaaccacggaaccccgtaacgggtcccgttcccggtccccccgtttcggggttcccc

SEQ ID NO: 432355 - DNA, 623 bp, Homo sapiens
  misc_feature: GZ8MTXP01AQ8TS.19.85.H08.1.454.CMB.2.raw
  modified_base (206)..(206): a, c, t, g, unknown or other
  modified_base (229)..(229): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacngtcacctgcaccggaacaccaanaatgtcggcgaccagggagccgcgttggctgcagcaacgccacgggccccacccctacccaactcctgtcgtacagaactgaccaaccggccctacaaactatttacagagtagtactttccacctaccgaagaccaaaacaaaactcacgtcctactctacgacctattacctcgtacctccacgtcctacgacgacgacggtctacgactactacgtacgctacgacgccggtacggaccaccgacgtccgtcgtccgtcgtccgttcggtccggtttcgggccggtacgggaccgtaacggttccgtaccggtacccggttccggttcgggttaccgaaccggcccgtaaccggtcccgtcccggacccccgttccggttcccgttccccg

SEQ ID NO: 432356 - DNA, 671 bp, Homo sapiens
  misc_feature: GZ8MTXP01EG02Q.19.85.H08.1.454.CMB.2.raw
  modified_base (209)..(209): a, c, t, g, unknown or other
  modified_base (235)..(235): a, c, t, g, unknown or other
  modified_base (256)..(256): a, c, t, g, unknown or other
  modified_base (339)..(339): a, c, t, g, unknown or other
  modified_base (346)..(346): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtggtccggggctggggacacggcccgcacngtccacctgacaaccggaacaccaanaatgcgcgacgagggcgccgntggctgcagccgaacgccgacggccccacccctacccaactcctagtaccgtaacaggaactacgaccaacccggtaccctanaaaactnttaccgagtacgtagttacctttaccactacgaagtaccaaaaaactaaaactccgactcccttactacgtaacgtacctacttacgtcgtaccctacgacgtcgtacggaacggacgaggtacctacgtaacctacgtacgtcgtaccgttaccggacggtacccggtacggaacccctaaccgtccggtcccttcggccgttcggtccgtttacgggttccgtttacggggaacggtaacgggaaacctacggttcgtccggtaccggttcgttcgggcctaacgcccgaagttcccgcgttaccccgtgttccgttaacccg

SEQ ID NO: 432357 - DNA, 587 bp, Homo sapiens
  misc_feature: GZ8MTXP01BMTYL.19.85.H08.1.454.CMB.2.raw
  modified_base (325)..(325): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagccaacgccagggcccaccctcccaactcctgtcgtacaggatgacaaccggccctacaaacntttcagagagtacttttcactcagacaaacaaaatcagtccctactctagaacctattacctcggtcctccacgcctagacgacgacggctcgaactacgtactgtctccgagcccgtcgggaccacccacgcccgtcgccgtcgtcttcgggtccgttttcgggaacgggacgggccaaacggttccgtcgtacccggttcccggttcgggttccgaacgccccgaacggtcccgtcggcccccgtcggttccctaacccg

SEQ ID NO: 432358 - DNA, 577 bp, Homo sapiens
  misc_feature: GZ8MTXP01BQX1H.19.85.H08.1.454.CMB.2.raw
  modified_base (346)..(346): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagcttggttcagcctgggaggtccctgagagtctcctgcacagcctctggattcaccttcagtaactatgagatggactggatccgcaggctaccgaggaagggctggagtggattcgcccatgtcacgtggngaggcaagtcacgtcacgcggactcgtggtcggccgggggtccgtttaccgatccgtaccaggacgtaacaacgtcgaccgaaaggaacgacgtcttctttctgggaccgttaagttcgggaccggtccgttaggaagtagtaccgaaagtacgacggtcttatttaattacgttgtgttaggaggaggaggggcaggtggcgttgggtcgggtcagtttcgtttgtaagg

SEQ ID NO: 432359 - DNA, 548 bp, Homo sapiens
  misc_feature: GZ8MTXP01ERPM7.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagccgtggagggtccctgagagtctcctgcacagcctctggattcaccttcagtaactatgagatggactggatccgcaggctccgaggaaagggctggagtggattgctatgtcacctagtgaggcaagtcacgtcctagcgactcgtgtgcggggtccgttacatctccagagacaatgaccaagaagacgctactttctggactaagttggaaccggcctgagagtacgaagacgacggtctaatttaattaacgttgtagttgaggaggagggggcacgtgggcgttcgggtcgggtccgttagttcgttttgttaaggg

SEQ ID NO: 432360 - DNA, 624 bp, Homo sapiens
  misc_feature: GZ8MTXP01EYB6Z.19.85.H08.1.454.CMB.2.raw
  modified_base (362)..(362): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgcccacccgtcggtcggtcccgggggcctggggacacggccgccacacgtccacctgaccgaaccgggaacaccaaacaagtcggtacggacgaccgaggggacgcccgcttggctgcagcaacgccacgggccccacccgtacccaaactcctgtcgtacgaggaactcgaccgaacccggccctacaaactntttacagagtacgtactttccacctcgaacggaacaaaacaaaatccacgtccctactactacgaacctatttaccgtcgtcctaccgacgcctacgacgaacgacggtctagaactacgactcgcctacgacgtccgtacgggaccacaccgcctcgtctcgtcgttcggtccgtttcgggcgggtacggaccgaagttccgtacggaccgttcgttcggttccgaacgccgaacggccgccgttccccgtcgttcgtccc

SEQ ID NO: 432361 - DNA, 555 bp, Homo sapiens
  misc_feature: GZ8MTXP01AN22U.19.85.H08.1.454.CMB.2.raw
  modified_base (344)..(344): a, c, t, g, unknown or other
  modified_base (443)..(443): a, c, t, g, unknown or other
tcagtactctcgtgcacgaccggtgctcgatttagtatcactcagtcgcggggtcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctggagggtccctgagagtctcctgcacagcctctggattcaccttcagtaactatgagatggactggatccgccaggctccgaggaaggggctggagtggattgcctatgtcactagnggaggcgaagtccgaaacgtccctaacggcggactcgtggtcggccgggggtccgtttaccatctccagagaaccaatcgaccaagaacgacgctcttntgacgtaattggacgctgagagtcgaagcacggcttagtttataacgtgttgtgaggagggtgggggcgcgttggcgtgggtcgggtcgtagttcgtttggttgtttcgggg

SEQ ID NO: 432362 - DNA, 596 bp, Homo sapiens
  misc_feature: GZ8MTXP01ASRFY.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgcacagtcacctgcaccggaacaccaacaatgtcggcgacccgagggagccgcttggctgcagcaacgccacgggcccacccctcccaaactccctgtcgtacaggaactcgaccaacccggccctacaaactatttacagagagtactttcactcagacaaacaaaatcagccctctctacgaccattactcgtcctccagcctgacgacggacggctacgactactactcgctcgacgtccgtacgggaccaccgacgccctcggccttcggtcttcgggtccgtttcggggaacggtacgggacccgacgttccgtacgggtacccgttccgttcggggttccaaccggcccgaacggtcccgtccggttcccccgtcgggttccctaacccg

SEQ ID NO: 432363 - DNA, 609 bp, Homo sapiens
  misc_feature: GZ8MTXP01DFDHK.19.85.H08.1.454.CMB.2.raw
  modified_base (277)..(277): a, c, t, g, unknown or other
  modified_base (403)..(403): a, c, t, g, unknown or other
tcagtactctcgtgcacgaccggtgctcgattttagtatcactcagtcgcggggtctcagagaggtgccttagtcctggagtccaaggcacttccacttggtgatcagtactgaacacagaggactcaccatggagttggggttgtgctgggtttttccttgtcgctattttagcaggtgtccaatgtgaggtggagttggtggagtcgtgggggaggcttggttcagcctggagggtccctgagagtctcctgcacagcctctggacttcaccttnagtaactatgagatggactggactcccgaccgaggcctacgaagggaaagggggctagggagtggatttgcctagtgtcaccgtaggtggagggacgaagtccaccgtccgtacgcggtacttcgnggtcgggccggggtcccgttacatcgtacagacgacaagtcgaccaaagaacgcgtacttctttctaggactaagttcggacgtccgtaggagacggtacgaaagacgtacggtacttaatttaagttacgttggttgagggtaaggaggggagggggcacggtgggcgttcggggtcgggtacgttagtttcgttttgttaaggg

SEQ ID NO: 432364 - DNA, 592 bp, Homo sapiens
  misc_feature: GZ8MTXP01APCC6.19.85.H08.1.454.CMB.2.raw
  modified_base (249)..(249): a, c, t, g, unknown or other
  modified_base (320)..(320): a, c, t, g, unknown or other
  modified_base (366)..(366): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctggggacaggccgccacagtcacctgcaccgggaacaccaacaatgtcgcgaccaggganccgcttggctgcagcaacgccagggccaccctccaaactcctgtcgtacaggaatcgacaaccggccctanaaacatttcagagagtactttcactcaggacaaacaaatcagcctntctgacctattactcgtctccacgctgacgacgacggctgacctactactgctcgagcccgtagggaccaccagtccctcgcgtcgtccgtttcgggtccttttccggggcgggaacgggacccgtaaacggccgttacggaaccccggttccgttcggggttacccaacgggtcccccgaaagggtccccgttccggccccccgttcgggttcccgtttaacccg

SEQ ID NO: 432365 - DNA, 561 bp, Homo sapiens
  misc_feature: GZ8MTXP01ADS1M.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagcttggttcagcctggagggtccctgagagtctcctgcacagcctctggattcaccttcagtaactatgagatggactggatccgcagctccgaggaaagggctggagtggattgcctatgtcacctgtgaggcaagtcacgtcctagcgatcgtgtggcggggtcccgttacatctccagagacaagtcgaccaaagaagacgtctctttactggactagttcggacggtccgtgagagtacgaagtacgacggtcttagtttaatacgttaggtgttggaaggtagggaggggggcttacggtgggtcgtggggttccgggtcggttagtttcgtttggttaagg

SEQ ID NO: 432366 - DNA, 598 bp, Homo sapiens
  misc_feature: GZ8MTXP01C1VWJ.19.85.H08.1.454.CMB.2.raw
  modified_base (259)..(259): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtcggtccgggggcctgggacaggcccgcacagtcacctgccaaccgggaacaccaacaatgcggcgaccaggggagccgnttggctgcagcaacgcacggcccaccctccaactcctgtccgtacaggaactcgaccaccggaccctacaaactatttacagtagtacgtactttccacctcaagtacaaaacaaaatcaacgcctactctacgacctatactcgtctacacgctagacgagacgctacgactactacgtgactcggacgccgtagggaaccacccgagtcccgtcgtcctcgtcgttcggtccgtttcgggaacgggtacgggttaccaacggccgtacggtccgttaccgttgggttaccaacggacccgaagggcccgtcccgaccccgtccggttaaccttcccg

SEQ ID NO: 432367 - DNA, 691 bp, Homo sapiens
  misc_feature: GZ8MTXP01BT4RX.19.85.H08.1.454.CMB.2.raw
tcagtactctcgtgcacgaccggtgctcgatttagtatcactcagtcgcggggtccaaacagagcttcagcaagcatagtgggaatctgcaccatgcccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcgacgaccgagggagccgcttggctgcagcaacgccaggcccacccctccaaactcctgtcgtaacagaactacgaccaaaccggccctacaaaacatttaccagagacgtacctttactacctcgaagaccaaaacaaaacaacgaatacccctactacctagtaaccctaagttacctcggtacctaccacgccctacggaacgaacggaacggtacttacggaacttaacctaactcgtaccgttacgaacgtacccgtacgggaaccaccgtaaccgcctccgtccgttcggtaccggtttcggtccgtttttccggggaaccgggttaacgggttaacccgaaacggttccgtaccggtaccccggttacccggttccggggttacccgaaccggtaccccgaaacggtccccgtacggttcccccccgtaacgggttcccttaaccccg

SEQ ID NO: 432368 - DNA, 620 bp, Homo sapiens
  misc_feature: GZ8MTXP01C1UJ0.19.85.H08.1.454.CMB.2.raw
  modified_base (270)..(270): a, c, t, g, unknown or other
  modified_base (275)..(275): a, c, t, g, unknown or other
  modified_base (601)..(601): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctctcactcactctgcagtgtcagtggtccaggcaggactgactcgacgccacccgtcggtcggtccgggggcctgggaccacgggccgccacgacgtcaccgtgaccgaccggaacaccaacaagtcgcggcgaccgagggacgccgntggcngcagcaacgccacggcccacctaccaaactcctagacgtacaggaatcgaaccgaaccgccctaacaaactacttacgaagtacgtaccgttactttacacctacgaacgaaactaacaaactcacgtaccctctactacgacctattacgtcgtacctacctacggcctaggaaccgacggtacgacttacgacttaactacgttcgacttacgacgccgtacgggaacctaccgacgcccttacggcttggtccgttggttaccggtttcgggacggacgggtacacggtctcggaccgttcgttcgggcaccgccgaggcccncgtccccgttcggtaaccc

SEQ ID NO: 432369 - DNA, 734 bp, Homo sapiens
  misc_feature: GZ8MTXP01EBGJV.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgacccctcctcactcactctgcagtgtcagtggtccaggaaggactgactcagccacccgtcggtcggtccggggcctgggacacggccgccacagtcacctgacgaccggaacaccaacaatcggtcggacgaccgagggacgccgcttggctgcagacaacgccgacgggcccacccctacccaaactccgtgtacgtacaggaactacgaaccaacccggtaccctacaaaactactttacgaagtaacgtaacgtacttttttaccccaacccttaccgaaaggtaaacccaaaactaaaaaaaacttaccgaacgtcccttaccgtactacgaaccttaattacgttcggtaccctacgacgtaccacggaaccgaacggacggtacctacggtaacctactacgtcgacttaccgacgggtaccgtacggggaaccctacccgacgtccccgtcgccgttcgtccgttcgggttccgtttcggggacgggtaacgggaccgaacggtccgttaccggtaacccggttccggttcgggttaccaccggaaccccggtaacggtcccgttacccggcccccggttacggttccccgttaaccgtttcccccggg

SEQ ID NO: 432370 - DNA, 537 bp, Homo sapiens
  misc_feature: GZ8MTXP01BPFW9.19.85.H08.1.454.CMB.2.raw
  modified_base (273)..(273): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgcttggttttccttgtcgctattttagcaggtgtccaatgtgaggtggagttggtggagtcgtgggggagcttggttcagcctggagggtccctgagagtctcctgcacagcctctggattcaccttnagtaactatgagatggactggatccgcaggctccgaggaaagggctggagtggattgcctatgtcactagtgagggcaagtcacgtcctacgcggactcgtgtgcggggtccgttacatctccagagacaatgaccaagaacgacgctctttctggctaagttggacggccgtgagagtacgaagcgacgtctatttaattacttgtgttgagagggagggggttcacgtggcgtgggtcgggtcgttagtcgttttggtaagg

SEQ ID NO: 432371 - DNA, 602 bp, Homo sapiens
  misc_feature: GZ8MTXP01C9IM4.19.85.H08.1.454.CMB.2.raw
  modified_base (202)..(202): a, c, t, g, unknown or other
  modified_base (206)..(206): a, c, t, g, unknown or other
  modified_base (246)..(246): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtggtccggggctgggacaggccncacngtcacctgcaccggacacaacatgcgcgaccaggagccgnttggctgcagcaacgccagggcccaccctccaaactcctagtcgtacaggatcgaacaaccggccctacgaaactatttacaagagaacgtacttttcctaaccgtaccaaggaaccaaaactaaaatcaacggtccctactacctacgaacctacttaactggtccttacgacgcctagacgacgacgctacgactactactcgctcgacgtccgtacggaccaccacgccctcgtcgtcgtcgttcggtcgttttcgggcggacgggaccgaaacgttcgtacgtcccgttcgttcgggttccgaacggcccgtaaggcccgtaccggccccgttaacgggttccttaaccccg

SEQ ID NO: 432372 - DNA, 363 bp, Homo sapiens
  misc_feature: GZ8MTXP01ASQYQ.19.85.H08.1.454.CMB.2.raw
  modified_base (254)..(254): a, c, t, g, unknown or other
  modified_base (359)..(363): a, c, t, g, unknown or other
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagaggagggggcactggctggtcgggtcgattcttttgatttggtggggccaaggatcaagcgtctccgtctcttcagcctccaccaaggcccatccgtcttccccngccaccctctccaagcgcacctctgggggcacagcggccctgggctgcctggtcaaggacctacttcccacgagagtactgagcgggctggcaaggcgccatagnnnnn

SEQ ID NO: 432373 - DNA, 655 bp, Homo sapiens
  misc_feature: GZ8MTXP01AP5IY.19.85.H08.1.454.CMB.2.raw
  modified_base (496)..(496): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgcccaccccgtcgggtcggtcccgggggcctggggacacggccgcccacacgtccacctgaccgaacccgggaaccaccaaacaagtcggtccggacgaccgagggacgccgcgtggctgcacgcaacgccgacgggcccaccccgtacccaaactccgtcgtacgtaacgacggaatacgaccgaacccggccctacaaactctttacagtagtacgtacttttccaacgtaccgaacgaacaaaacaaaactcacgtccctactcgtacgacctacttactacggtcctaccacgtcctaggacgacgacggctacgactactacngacctcgacggtccgcggaccacgacgtccgtcgtcgtcggtccgttcgggtccgtttccggggcgggtaccgggaaccgacggccgttacgggacccgttcggttcgggaccaacggtacccggaacggccgtcccgccccgtcggttaaccttcccg

SEQ ID NO: 432374 - DNA, 541 bp, Homo sapiens
  misc_feature: GZ8MTXP01DM427.19.85.H08.1.454.CMB.2.raw
  modified_base (475)..(475): a, c, t, g, unknown or other
  modified_base (506)..(506): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtccgggggcctggggacaggccgccacagtcacctgcaccggaacaccaacaatgcggcgaccagggagccgcttggctgcagcaacgccagggcccaccctccaaactcctgtcgtacaggaatgaccaaccggccctacaaacatttacagagagtactttccactccagacaaacaaaatcagcctctctacacctattactgtctcctacgcctgacgacgacgctagactactactgcctcgacgccgtcgggaccacacgcctcgctcgtcttcgtcgtttcggcggnggttaccagcgtcgcgttccgttcgggttcncgaccgaaggtcctcgccccgtcgttcgtaacccg

SEQ ID NO: 432375 - DNA, 718 bp, Homo sapiens
  misc_feature: GZ8MTXP01B74AN.19.85.H08.1.454.CMB.2.raw
  modified_base (214)..(214): a, c, t, g, unknown or other
  modified_base (237)..(237): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagcccacccgtcggtcggtccgggggcctggggaccacggccgccacngtcacctgcaccggaacaccaanatgcgcgaccgagggagccgcttggctgcagcaacgccagggcccaacccctcccaaactcctgtcgtacaggaactcgaaccaaccggccccttacgaaactactttacaaggacgtacgttaaccttttccgtaacctacgaacggaaccaaaaccaaaaaacttccgagtccctactactacgacctaattacctcggttcctaccgtacgcctacggaacgaccggtaacggcctacggaccttacgtactacggtccttacgacgtacccggttacgggaaccaacccgacgtcccgtcgtcgttcggtccgtttcgggtccggtttttacggggaaccggggtaaaccgggttaccggtaaacggttccgttacgggtaacccgggtttcccgttcgggggttacccgaaccgggacccccgtaacgggtccccggtcccggttaccccccggtccgggttccctttaaccccgg

SEQ ID NO: 432376 - DNA, 596 bp, Homo sapiens
  misc_feature: GZ8MTXP01DGZ85.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctgggagggtccctgagagtctcctgcacagcctctggacttcaccttcaagtaactatgagatggactggactccgccaggctccgagggaaagggctggagtggattgcctagtgtaccacgtaggtggagggacgaagtccacgtccgtacgcggactcgtggtcggcgggggtcccgttacagtcctaccgagacgaacaagtacgaccgaaagaacgacgcttctttccgtgggtactaagtttcgggacgtccgtaggacgtagtacgaagacgacggtcttaattttaattaacgttggtgttaggaggagggagggggcacggtggtcgtgggtcgggtcgttagtttcgtttggttaagg

SEQ ID NO: 432377 - DNA, 805 bp, Homo sapiens
  misc_feature: GZ8MTXP01CP9NI.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtcggtcccgggggcctggggacacggcccgccacagtcaccgtgacaaccgggaacaccaacaatcgtcggcgaccgagggacgccgcttggctgcagcaacgccacgggtcccacccctcccaaactccctcgtacgtaacacgggaatacgaacccaaccggtccctaacaaactactttacaacgagtacgttaaccttttccgtaaacctccgaaggaaacccaaaaactaaaaaactaaccctaacgtacccttaccttaccgtacggtaaacccctaatttacccgttacgggttaccctacccgtaacggtcccttaacggaacccggaacggtacgggtacccttacgggaaaccttaaccgttaacgtcgtaccccgttacgaaaccgggtccccgttacggggaaccctaaccccgtaacgccccgttacgtacccggtttccggtccggttttaaccgggttcccgtttttccgggggaacccgggttaaccgggggaaaccctaaacggttcccggtacgggtaaccccgttccgggttacgggttacccgaaccggtaccccggtaacggtcccgtccccggttccccccgttccgggttaaccgtttccccg

SEQ ID NO: 432378 - DNA, 548 bp, Homo sapiens
  misc_feature: GZ8MTXP01BK0IB.19.85.H08.1.454.CMB.2.raw
  modified_base (248)..(248): a, c, t, g, unknown or other
  modified_base (253)..(253): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacccgtcggtggtccgggggcctgggacaggccgcacagtcacctgcacggacacaacatgcgcgacagggagccgntggcngcagcaacgccacggcccacctccaaactcctgtcgtacaggaatcgaaccaacccggcctacaaactatttacagagtacgtatttcaacctccaagaaacaacaaatacacgcctactactacgacctattactacggtcctaccacgcctagacgacgacgctacgactactactgctcacgccgtacggacaccgagcctcgctgtcttcggtcgtttcggcggacgggtaccagccgtcgacccgttcgttcggtcacggccgtacggccttaccgtccccgttggtccc

SEQ ID NO: 432379 - DNA, 646 bp, Homo sapiens
  misc_feature: GZ8MTXP01B85J6.19.85.H08.1.454.CMB.2.raw
  modified_base (211)..(211): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgcccacccgtcgggtcggtccgggggcctgggaccacggccnccacacgtccaccgtgaccgaaccgggaacaccaaacaagtcggtaccgggaccgaccgaggggacgccgtcgttggctgcagcaacgccgacggccccaccctacccaaactcctgtacgtacgaacggaactcgaaccaacccggccctaacaaactctttacagagacgttactttacacctccaaggtaacaaactaatacacgtcctactcacgactattactgtacctcacgcctagacgacgacgtactacgacctacgtactacgcgtacacgccgtacggaccaccgcgtacctcgctcgtccgtcggtcgtttaacgggcggacgggtaccgacgtccgtcggacccggttcggttaccgggtaaccgacccggtaacccggaaccgggtcccgttaccccggtccccgttaaccgggttccccc

SEQ ID NO: 432380 - DNA, 675 bp, Homo sapiens
  misc_feature: GZ8MTXP01CFGRS.19.85.H08.1.454.CMB.2.raw
  modified_base (264)..(264): a, c, t, g, unknown or other
  modified_base (270)..(270): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccaccgtcggtcggtccggggcctgggacaggccgcacagtcaccgtgaccgaaccggaacaccaacaatcggtcggacgaccgagggacgccgngtggcngcagcaacgccgacggccccacccctaccaactcctagtaccgtaacaggaactacgaaccgaacccggtccctaacaaactatttaccgaagtacgtacgttaaccctttttaccaaccgtaccgaaacggaacctaaaaaactaaaaactcaaccgtacccttactaccgtaacgaacccttaattacccgtacggttacctaccgtacgaccgtacgaaccggaacgtacggtacctacgtaaccttactaaccgtcgtacctcggaacgtccgacggaaccacccgacgtcccgtcgtcgtcgtccgttcggtccgtttcgggcggtacggacgaacgcgtaccgtccgttccgttcggccgaacgcccgtaacgcccgtaccgccccgtcgttcctcccg

SEQ ID NO: 432381 - DNA, 569 bp, Homo sapiens
  misc_feature: GZ8MTXP01CNF96.19.85.H08.1.454.CMB.2.raw
  modified_base (225)..(225): a, c, t, g, unknown or other
  modified_base (244)..(244): a, c, t, g, unknown or other
  modified_base (269)..(269): a, c, t, g, unknown or other
  modified_base (277)..(277): a, c, t, g, unknown or other
  modified_base (282)..(282): a, c, t, g, unknown or other
  modified_base (298)..(298): a, c, t, g, unknown or other
  modified_base (303)..(303): a, c, t, g, unknown or other
  modified_base (310)..(310): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccgtcggtggtccggggctggacaggccgcacagtcactgcaccggaacacaanatgcgcgacgaggagccgntggctgcagcaacgcacggccaccnccaactcngtcanagatcgacacgcctanaactnttcaganagtactttcactcagaacaaaacaaaatcgactcctactacctacgaactattaacctcgttacctaccgacgccgtacgaaccggaacggacggtactacggaaccttaacgtaactcgtacctacggacgtccgtacgggaccaccgacgccctcgcctgtcgttcgtcgtttacgggcggtaacggactaacgcgtacggaccgttcgttcgggacaacgacccgtaacggcctcccgcccctcggttccgtcccg

SEQ ID NO: 432382 - DNA, 723 bp, Homo sapiens
  misc_feature: GZ8MTXP01C4FBP.19.85.H08.1.454.CMB.2.raw
  modified_base (214)..(214): a, c, t, g, unknown or other
  modified_base (244)..(244): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtggtccgggggctgggacaggccgcacagtcaccngcaccggaacacaacaatgcgcgacaggancgctgctgcagcacgccaggccaccctccaactcctgtcgtacaggaatcgacaaccggccctacaaactattcaagtagagtactttccacctcgaacggaacaaaactaaaactaacgaaccgtcctactactacgaacctaacgttacgtacggttcctacccgacgtacccgttacggaaccggaacgaacgggtaccgtacgtaaccttaacctaaccgttacgcccgttacggaaccggtacccgttaacggggacccaaacccgaacccgtcccgtccggtaccgttcggtccgttttcgggtcccggtttttccgggggaaccgggttaacggggaaacccgtaaacgggttccgttacccgggttaacccggttcccgggttcggggttcccggtaacccggtacccccggaaaccgggttcccggtccccgggttccccccgttcccggggttcccctttaacccccgg

SEQ ID NO: 432383 - DNA, 653 bp, Homo sapiens
  misc_feature: GZ8MTXP01BU0GP.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgcccacccgtcggtcggtccgggggcctggggacacggcccgccacagtccacctgaccgaaccgggaacaccaaacaagtcggcggacgaccgagggacgccgcgttggctgcagcaacgccacggcccaccctcccaactcctacgtacgtacaggaactcgaaccaacccggcccctaacgaaactatttacagtacgtacgttaccttttaccacctaccgaaggaaccaaaactaaaactcacgtccctaccgtactacgaacctattaccgtcgtacctaccacgtccgtacgacgacgtacgtactcgtaactacgtacgtcgtaccgtcgacgtcccgtacgggacccaaccgcgtccctacggcctcgtccggtttcggtccgtttcggggaaccggtacggacctaacgccgtacgtaccgttcgttcggttaccgcgacccgaacgtccgtaccgttcccgtccgttcgtcccg

SEQ ID NO: 432384 - DNA, 804 bp, Homo sapiens
  misc_feature: GZ8MTXP01C7NB6.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccgtcggtcggtccggggcctgggacacggccgcacagtcacctgccaccggaacacaacaatcgtcgacgacagggacgccgctggctgcagcaacgccacggccaccctccaaactcctgtcgtacgaggaactcgaaccgaaccggtccctaacaaaactatttacaagtacgacgttaccttttaccaccttaccgaaaggtaacctaaaaccaaaaaacttccgaaacgtcccttacctactacgaacccttaactttaaccgtcggttaccttacccgtaaacgcccgttaacggaacccggtaaaccggacgggtacctaacggtaaaccttaccttaacgtcgtaccttacgacggttacccgtaacggggaacccctaaacccgaccgtcccgtaccggtaccgttcggttccgtttacgggttccccggtttttaccgggggtaacgggtaaaccgggggttaaccccgtaaaacggcccggtttaaccgggtaaaccccgggtttaccgggttccggggtttaaaccccggtaaccggtaaccccccgggaaaacgggttcccccgggtaccccgggttcccccccgttaaacccgggggttccccttttaaaccccccggg

SEQ ID NO: 432385 - DNA, 589 bp, Homo sapiens
  misc_feature: GZ8MTXP01A2HZB.19.85.H08.1.454.CMB.2.raw
  modified_base (247)..(247): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtcggtccgggggcctggggacaggccgccacagtcacctgcaccggaacacaacatgcgcgacaggganccgctggctgcagcacgccagggcccacccctccaaactcctgtaccgtacaggaactcgaccgaacccggccctacaaactattccaagagtacgtacttttccacctacaaggacaaaacgaaatccagtccctctactacgtacctattactcggtctccacgcctacgacgacgacgactcgactactactcgctacgacgccgtcggacctaccacgcctcgtctgtcgttcggtccgtttcgggaacggtacggaccgtaacgttcgtccgtaccggttccgttcggttcccgaacgcccgaacggtccgtaccgttccccgtcgttccgtccccg

SEQ ID NO: 432386 - DNA, 569 bp, Homo sapiens
  misc_feature: GZ8MTXP01ESOO0.19.85.H08.1.454.CMB.2.raw
  modified_base (336)..(336): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcgggtggtccgggggcctggggacacggccgccacagtcacctgcaccggaacaccaacaatgtcggcgaccgagggagccgcttggctgcagcaacgccacgggccaccccgtaccaaactcctgtcgtacaggaatcgaccaaccggccctacgaaacntttacagagagtactttccactcagacaaacaaatcacgcctctctagacctattactcgtctccacgcctagacgtaacgacgtactacgactacactcgctacgacgtccgtacgggaccacgacgccgtcgtctcgtcgttggtccgtttcgggcggacgggacacggcgtcggacccgttcgttcggttcgaacgtcccgaacggctaccgccccgtcggttcccgccg

SEQ ID NO: 432387 - DNA, 672 bp, Homo sapiens
  misc_feature: GZ8MTXP01CNOBF.19.85.H08.1.454.CMB.2.raw
  modified_base (218)..(218): a, c, t, g, unknown or other
  modified_base (543)..(543): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctcgaccctcctcactcactctgcagtgtcagtggtccaggcaggactgactcacgcccacccgtcgggtcggtcccgggggcctggggacacggccgccaacncgtcacctgaccaaccgggaacaccaaacgaagtcggtacggacgaaccgaggggacgccgtcgttggctgcaggccaacggccgacgggccccacccgtacccaaactccgtacgtacgtaacgaggaactcgaaccaacccggccctaacaaactatttacgaagtagtagtacccttttacaccgtcgaaacggaaccaaaactaaaactccgacgtccctactctacgaacccttagttacttcggtcctaccgacgtccgtagaaccgacgtacgtactacgacttactactcgacctacggacggtccgtcggaacccnccgaccgtccacgtcctcgttccgtcggttccggttcggaaccgggtaacggaccgtacgcgtaccgtccgttccggttcggaccgtccggacccgtaacgcccgtcccgcccgtcggttccctaaccg

SEQ ID NO: 432388 - DNA, 638 bp, Homo sapiens
  misc_feature: GZ8MTXP01D4VIF.19.85.H08.1.454.CMB.2.raw
  modified_base (273)..(273): a, c, t, g, unknown or other
  modified_base (475)..(475): a, c, t, g, unknown or other
tcagtactctcgtgcacgaccggtgctcgatttagtatcactcagtcgcgggatccaaacagagcttcagcaagcatagtgggaatctgcaccatgccctgggctctgctcctcctgaccctcctcactcactctgcagtgtcagtggtccaggcaggactgactcacgccacccgtcgggtcggtccgggggccgtgggacacggccgccacgagtcacctgccgaccgggaacaccaaacaatcggcggcgaccgagggacgccgctggcngcagcaacgccacgggcccacccacccaaactcctgtacgtacgaaggaactcgaaccgaacccggcctacgaaactactttcaagtacgtacgtacttttcacctactaacgaaaccaaacaaatcacgacccttctactacgaacctattacgtcgttcctacacgtcctaggacgacggaggtactagacctacgtacngtaccggtacacggccgtagggacccaccgtacgtccgtccgcgtcggttcgttcgggtccggtttcgggaccgggagggaacccaaggtccgtccgggttaacccgttcgttacggggaaccaccgcccgtaacgggccttaccggtccccgttcgtaaccc

SEQ ID NO: 432389 - DNA, 666 bp, Homo sapiens
  misc_feature: GZ8MTXP01BKRG2.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccgggggcctggggacacggccgccacagtccaccgtgaccgaaccgggaacaccaacaagtcgtacggcgaccgagggacgccgcgttggctgcagcacgccaggcccaccctacccaaactccgtagtaccgtacaggaactcgaccaacccggccctacgtaaactatttacgaagtagtacgtacttttaccgacctacgaacggtaaccaaaactaaaactccgacgtccctactaccgtacgtaacctagtttacctacggtcctaccgacgtaccgtacgaacggtaccggacggtactacgacctacgtacgtacgccgttcggacgtccgtacgggacctaccgacgtccgtcgtcgtcgtcgttcggtcgtttccgggcggtacgggaccgacgttcgtaccgtaccggttccgttcgggttaccaacgcccgtaacggtccgtcccgttccccgtcgttccgttaacccg

SEQ ID NO: 432390 - DNA, 607 bp, Homo sapiens
  misc_feature: GZ8MTXP01D0QS6.19.85.H08.1.454.CMB.2.raw
  modified_base (586)..(586): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccgggggctggggacacggccgccacagtcacctgcaccgggaacaccaacaatgtcggcgacgagggacgccgctggctgcagcgaacgccgacggcccaccccgtacccaactcctgtacgtacaggaactcgaaccaaccggccctaacaaactatttcaagtatacgttactttcctactacgaagaaccaaaaacaaactcacgtccctactctacgacctattactcgtctaccacgctagacgtacggacggtctacgactacgtactcgtactacggacggtccgtacggaccaccgcgccgtcgtcgtcgtcgttcgggtacgtttcgggggaacgacgggttaccaacgttcgtacggtacccgcgttgggttccaacgccgaacggtccncccggccctcggttctcccgg

SEQ ID NO: 432391 - DNA, 589 bp, Homo sapiens
  misc_feature: GZ8MTXP01EC1LE.19.85.H08.1.454.CMB.2.raw
  modified_base (269)..(269): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgcccacccgtcgggtggtcccggggggcctggggacacggcccgccacagtccacctgccaaccgggaacaccaacaatcgtcggcgaccgagggagccgnttggctgcagcaacgccacgggccccaccctcccaaactcctgtcgtacaggaactcgaccaaccggccctacaaactatttacagagagtactttccactacagaccaaacaaatcacgcctctctacgacctattactcgtctaccacgcctgacgacgacgactcgactaccgtactcgactcgaacgtccgtacgggaccaccacgcctcgcgtcgtcgttcggtcgtttcgggcggtacggacgacgttcgtcggtaccgttccgttcgggttacgcgaccgaacggtccgtccgccccgtcggttcctaacccg

SEQ ID NO: 432392 - DNA, 637 bp, Homo sapiens
  misc_feature: GZ8MTXP01EE7RD.19.85.H08.1.454.CMB.2.raw
  modified_base (240)..(240): a, c, t, g, unknown or other
  modified_base (264)..(264): a, c, t, g, unknown or other
  modified_base (340)..(340): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagcccacccgtcgggtcggtccgggggcctggggacacggcccgccacacgtcacctacgaccggaacaccaanaatgtcggcgacgagggacgccgnttggctgcagcaacgccagggcccaccctacccaaactcctagtcgtacaggaatcgacaaccggcctacaaactnttcagtagagtacttttccacctacaagacaactaaaaaactcaacgcctactctacgacctattacgtcgtcctcgacgtcgacgaacgacgacgtctacgtactactacgtcgtacctcgacggtacggtacggaccaccgtacgtccgtcgtcgtcgttcggtcggttaccggttcgggacggggtaacgaccgttacggtccggttacggtacccgttcgggttacggttccgacccggtaaccggtaccggtccgtccccggtcccggttacgtcccgttccgttaaccccg

SEQ ID NO: 432393 - DNA, 565 bp, Homo sapiens
  misc_feature: GZ8MTXP01C95KM.19.85.H08.1.454.CMB.2.raw
  modified_base (534)..(534): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctggagggtccctgagagtctcctgcacagcctctggattcaccttcagtaactatgagatggactggatccgccaggctaccgagggaaaggggctgggagtggatttgcctatgtcacctaggtagaggggcgaagtccacgtccctacgccgggacttcgtggtcggcggggtacccggttaccatcctaccagagaacaatcgaccaaagagacgctactttctggactaagttgggacggcctggagacgtacgaagacgacggtctatttaatacttggtgttgaggtggagggggcacgnggcgtgggtcggtcgttattcgtttgttaag

SEQ ID NO: 432394 - DNA, 575 bp, Homo sapiens
  misc_feature: GZ8MTXP01ACCYM.19.85.H08.1.454.CMB.2.raw
  modified_base (258)..(258): a, c, t, g, unknown or other
  modified_base (473)..(473): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacctcggtgtccgggggcctgggacaggccgccacagtcacctgcaccggaacaccaacaatgcggcgacgagggagccgcttggcngcagcaacgccacggggcccaccctacccaaactcctgtcgtacaggaactgaccaacccggccctacgaaacatttcagtagacgtactttacacctcgaggaaacctaacaaacttcaacgccttactcctacgacctactttactcggttcctccgaacgccttacgacgacgaggcacgtactactactcgctcaacgccgtacgggaccnccgacgcctcgctgcgttcggtcgtttcgggcgacgggtacgaagtctcggaccgttccgttcggtcacgcccgaacggcttcgtccccgttcggtaacccg

SEQ ID NO: 432395 - DNA, 581 bp, Homo sapiens
  misc_feature: GZ8MTXP01EKLUO.19.85.H08.1.454.CMB.2.raw
  modified_base (230)..(230): a, c, t, g, unknown or other
  modified_base (243)..(243): a, c, t, g, unknown or other
  modified_base (247)..(247): a, c, t, g, unknown or other
  modified_base (422)..(422): a, c, t, g, unknown or other
  modified_base (487)..(487): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtgtccgggggcctgggacaggccgccacagtcacctgcaccggaacacaanatgcgcgacaggnccgntgctgcagcaacgccagggccccacccctacccaaactcctgtcgtaacaggaactcgaccaacccggccctacaaactatttaccagagacgtactttccgacctcgaaggaccaaaccaaaatccacgtccctctctagacctaatttacctggtctccaagcctgacgacgngctagactactactgctacgacgccgtcgggacaaccgcgccttcgctgtcgtggtcgtttcggngggtacggaccgacgttcgtacggtacccggttcgttcgggccaacgggcccgtaacggggtccctccccggccccttccgggttcctccccgg

SEQ ID NO: 432396 - DNA, 725 bp, Homo sapiens
  misc_feature: GZ8MTXP01BBNCC.19.85.H08.1.454.CMB.2.raw
  modified_base (258)..(258): a, c, t, g, unknown or other
  modified_base (263)..(263): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgcccacccgtcgggtcggtccgggggcctggggacacggccgccacagtccacctgacaccggaacaccaacatgtcggcgaccgagggngccgntggctgcagcacgccgacggccacccctaccaactccgtagtacgtaacaggaactacgaaccaaccggtcccctaacaaactatttaccgaagacgtacgttaccttttccaaccgtaccaacggaaccaaaacaaaactcaacgtcccttactactacgtacctaattaccgtcgttacctaccgacgtacccgtacgaacggaacggtacggtccgtacggaaccgttacttaacccgtcgtacccgtacggaccggtacccggttaccggggaaccacccgaccgtcccgtccggtccgttacgggttcccgtttcggggttccgttttcgggggaacgggtaacggggacccgttaacgggcccgttacggtaccccgggttccgttcggggttaccaacccgggtcccgaacgggtcccgtccccggttccccgttccgggttaacccttccccgg

SEQ ID NO: 432397 - DNA, 688 bp, Homo sapiens
  misc_feature: GZ8MTXP01C2CEF.19.85.H08.1.454.CMB.2.raw
  modified_base (278)..(278): a, c, t, g, unknown or other
tcagtactctcgtgcacgaccggtgctcgatttagtatcactcagtcgcggggctccaaacagagcttcagcaagcatagtgggaatctgcaccatgccctgggctctgcctcctcctgaccctcctcactcactctgcagtgtcagtggtccaggcaggactgactcacgccacccgtcgggtcggtccgggggcctgggacacggccgccacacgtccacctgaccgaaccggaacaccaaacaagtcgcggacgaccgagggacgccgcgtggcngcacgcaaccgccgacggccccaaccctacccaaactcctacgtacgtaacaggaaactcgaaccgaacccggccctaacaaactactttacagacgtacgtacttttacacctaccgaaggaaaccaaacgaaactaccacgtcccttactacctacgtaaccctaatttaccgtcggttaccctaccgaacggtccgttacgggaaccgtaaccgggtacggtaccgtacggtaaccttacctaacgttcgaccgttaccgacggtacccgtcgggaacctacccgacgtcccgtcgtcgttcggtcgttcggttccggtttcggggcggacgggtaccaacgtccgtcgttacccggttcgttcgggtccacgcccgacggccttcccgtccccgttcggtaacccc

SEQ ID NO: 432398 - DNA, 631 bp, Homo sapiens
  misc_feature: GZ8MTXP01CR74O.19.85.H08.1.454.CMB.2.raw
  modified_base (231)..(231): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtggtccgggggcctgggacaggccgcacagtcacctgcaccggaacaccaanaatgcgcgaccagggagcgctggctgcagcaacgccaggccaccctccaaactcctgtcgtacaggaactgaccaccggtaccctacaaactatttccgaagtagtacgtacttttctaacctcgaacggaacaaaacaaaatcagtccctactactacgaacctacttaaactcggtactaccgaagccgtagaaccgacgacggtctacgaactactaacgtgacctacgaacgcgtacgggaccaccacggtcctcggactcgtcgttacggtccgttttcgggcgggtaacggaccgaaacggcgtaccggtaacccgttcccggttaggggttcccgaaccggaccccggaacggtcccgtcccggttcccccgttccgggttccttaaccccgg

SEQ ID NO: 432399 - DNA, 580 bp, Homo sapiens
  misc_feature: GZ8MTXP01EP43K.19.85.H08.1.454.CMB.2.raw
  modified_base (207)..(207): a, c, t, g, unknown or other
  modified_base (230)..(230): a, c, t, g, unknown or other
  modified_base (289)..(289): a, c, t, g, unknown or other
  modified_base (296)..(296): a, c, t, g, unknown or other
  modified_base (321)..(321): a, c, t, g, unknown or other
  modified_base (329)..(329): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacngtcacctgcaccggaacaccaanaatgcgcgaccagggagccgcttggctgcagcaacgccagggccaccctcccaactccngtcgtanaggatgacaaccggccctacaaacntttcaganagtactttcactcaggaccaaacaaaatcaagtcctactctacgacctattactcgtctccacgcctagacgacggacggactgactactactagtctcgacgtccgtcgggaccacgacgcctcgcctcgtcgttcggtccgttttccggggcggacgggaccgaacgttccgtacggtaacccgttccggttcgggttccgaacgcccgaacggtccctccggcccccgtaacggttcccgtaaccccg

SEQ ID NO: 432400 - DNA, 687 bp, Homo sapiens
  misc_feature: GZ8MTXP01BA5II.19.85.H08.1.454.CMB.2.raw
  modified_base (268)..(268): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgccacccgtcggtggtccggggcctgggaccaggccgccacagtcacctgccgaaccggaacaccaacaagtgtcggcgaccgagggacgccgctggcngcagcaacgccacggcccacccctcccaaactcctagtaccgtacgaggaactcgaccaacccggccctacaaactagtttccaagtacgacgtacttttacacctaccgaaggaaacccaacaaactcacgtccctactcagaccctaattacctcggtacctaccgacgtccgtagaccggacggtacggtcctaggtaccctacgttacgtcgacgtaccgaacggtcccgttacgggaaccacccgacgtccccgtcgccgttcggtcgtttcgggtccggttttcggggacggggaaccgggtacccgaaacgtccggtccggttaaccccggttccgggttacggggtaacccaacccgggtccccgaacggggtcccgttaccccgggtccccccgttccgggttaaccccg

SEQ ID NO: 432401 - DNA, 595 bp, Homo sapiens
  misc_feature: GZ8MTXP01DWL6T.19.85.H08.1.454.CMB.2.raw
  modified_base (247)..(247): a, c, t, g, unknown or other
  modified_base (250)..(250): a, c, t, g, unknown or other
  modified_base (255)..(255): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccacccgtcggtggtccgggggcctgggacaggccgccacagtcacctgcaccggacaccaacatgcgcgacaggancgntggcngcagcaacgccacggcccaccctcccaaactcctgtcgtacacggaatcgacaacccggccctacgaaactacttacagacgtacgtacttttcacctccaacggaaaccaacaaacgtcaacgtaccctctctacgacctattacctcgtcctacgacgacctagaacgacgaggacctgaacctactactcgctacgacgtccgtagggaccaccgacgcctcgctcggtcgttacggtccggtttcggcgggttacggacgacggtcgtcggacccggttcgttacgggtaaccgacgcccgaaccgggaccccttaaccccgtcgttaacgtcccg

SEQ ID NO: 432402 - DNA, 678 bp, Homo sapiens
  misc_feature: GZ8MTXP01CYEHW.19.85.H08.1.454.CMB.2.raw
  modified_base (212)..(212): a, c, t, g, unknown or other
  modified_base (367)..(367): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctcgaccctcctcactcactctgcagtgtcagtggtccaggcaggactgactcacgccacccgtcggtcggtccggggcctgggacacggccgccacncgtcacctgaccgaaccggaacaccaacaagtcggtcggacgaaccgagggacgccgtgttggctggcagccaacgccgacgggccccaaccccgtacccaaactccgtagtacgtaacgaggaactcggaaccaacccggtccctaacaaactnttacaacggtagtacgttaccctttttaccaccgtacgaacgtaacccaaaaaacgtaaatccacgtccctactcctacgtaacctaacgttacctcggttacctacccgacgtccgtacgacggacgtacggtctacgacttaacactgtcctcggacgaccgtcggaccacctaccgccgtcgtcgttgtccgttcggtccgtttcgggaacgggtacggaccgtaacgttcgtccggtaccgttccggttcggttccgaacggcccgtaacgggtcccgtcccgttccccggttcggttcctaacccg

SEQ ID NO: 432403 - DNA, 742 bp, Homo sapiens
  misc_feature: GZ8MTXP01A9E6E.19.85.H08.1.454.CMB.2.raw
  modified_base (268)..(268): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagcccacccgtcggtcggtccgggggcctgggacaggccgccacagtccacctgaccaaccgggaacaccaaacaatcggcggacgaccgaggggacgccgntggctgcagcaacgccgaggcccacccgtcccaaactcctagtaccgtacgacggaactcgaacctaacccggccctaacgaaacctactttaccgaagtacgtaacgttacctttttccacctaccgaacggaacccaaaaaacgtaaaaattccgaacgtaccccttactaccgtacgtaaaccccttactttaaaccgttcggtacccttacccaacggtccctaacggaccggtaaccggacgggtccttaacggtaccttaccgtacgttacgtccgttaccggacggtacccggtacgggacctaacccggccgccgtccgtaccgtcggttccggtttcgggtccgttttcggggaaccgggtaacggggttacctaacgggttccgtacgtacccgggttccgttcggggttccaaccgggcccgtaacggcccgttccggaccccgttcggttcccgttaacccg

SEQ ID NO: 432404 - DNA, 600 bp, Homo sapiens
  misc_feature: GZ8MTXP01D18ST.19.85.H08.1.454.CMB.2.raw
  modified_base (347)..(347): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgccacccgtcggtcggtccgggggcctgggacacggccgccacagtccacctgccaaccggaacaccaacaagtgtcggcgacgagggacgccgctggctgcagcaacgccgacggcccacccctcccaaactcctgtacgtacaggaatcgacaacccggcctacgaaactactttnagacgtacgtacttttacaccgtaccaggtaaaccaacaagtacacgtcctctacacgtacctattactcgttcacacgcctagaacgacgacggcacgtactacactcgctacgacgccgtagggaccaaccgtgccccgtacgtcgtcgtcgttcgggtccgtttaacgggcggacgggtacacgtccgtcgttaccggttccgttagggtccgacgccgtaacgccgttacccgtccccgttaaggtccc

SEQ ID NO: 432405 - DNA, 588 bp, Homo sapiens
  misc_feature: GZ8MTXP01EIGXD.19.85.H08.1.454.CMB.2.raw
  modified_base (253)..(253): a, c, t, g, unknown or other
  modified_base (262)..(262): a, c, t, g, unknown or other
  modified_base (285)..(285): a, c, t, g, unknown or other
  modified_base (362)..(362): a, c, t, g, unknown or other
  modified_base (366)..(366): a, c, t, g, unknown or other
tcagtactctcgtgcacgaccggtgctcgatttagtatcactcagtcgcggggctccaaacagagcttcagcaagcatagtgggaatctgcaccatgccctgggctctgcctcctcctgaccctcctcactcactctgcagtgtcagtggtccaggcaggactgactcacgccacccgtcggtggtccgggggcctgggacaggccgccacagtcacctgcaccggaacaccaacatgcggcgaccagggacnccgctggcngcagcaacgccacggcccacccncccaaactcctgtcgtacagaatgacacccgcctacaaactattcagagacgtatttacactacagaaacaactaancaanccctctactacgacctattacgtgtctacacgtacctacggaacgtacgacggtactacgaactaacgtactcgacgtcgacgtaccgtacgggaaccacccgacgcctcgcgtgtcgttcggtcgtttcgggacggacgggtaccgaagccgtcggaccccgttcgttacggggtccgacggccgtaaccggtccgttccgtaacccccgttcggtaaccc

SEQ ID NO: 432406 - DNA, 612 bp, Homo sapiens
  misc_feature: GZ8MTXP01C6GW9.19.85.H08.1.454.CMB.2.raw
  modified_base (337)..(337): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtcccgggggcctggggacacggcccgccacagtcacctgccaaccgggaacaccaacaatgcggcgaccgagggagccgcttggctgcagcacgcaggcccaccctccaactcctgtcgtacaggaactcgaccaaccggtccctacaaactntttacgagagtacgtacctttccaccgtcaacggaacaaaaccaaaagtcacgtcccttactacgtacgaacctacttactcggtcctaccacgcctacggacgacgacggactcgaacttactactcgcctcggaacgtccgtcgggaccaccgacgcctcgctcgtcttcggtcgtttcgggaacggacggacgacgcgtacggccgttaccggttcggttacccgaacgcccgtaacggtccctcccggttccccgtcggttcctaaccccg

SEQ ID NO: 432407 - DNA, 681 bp, Homo sapiens
  misc_feature: GZ8MTXP01BTXUD.19.85.H08.1.454.CMB.2.raw
  modified_base (363)..(363): a, c, t, g, unknown or other
tcagtactctcgtgcacgaccggtgctcgatttagtatcactcagtcgcggggctccaaacagagcttcagcaagcatagtgggaatctgcaccatgccctgggctctgcctcctcctcgaccctcctcactcactctgcagtgtcagtggtccaggcaggactgactcacgcccacccgtcggtcggtccggggcctgggaccacggccgccacacgtccacctgaccgaccgggaacaccaacaagtcgtacggcgaccgagggacgccgtcgttggctgcacgcaaccgccgacggccccacccctacccaaacctccgtgtacgtacgaggaactcgaccaacccggccctacaaactnttcagagtacgtactttcacctacaggaaaccaacaaactcacgtccctactctacgaaccttagttacctacggtcccttaccgacgtcccgttacggaacggtaaccggacgggtcctacggtaccttaacgtaccgtcgtaccgtacgacggtacccggtacgggaaccaccgacgtcccgtcgtccgtcggtccgttcgggttccgtttccggggacgggacgggtaaccacgggtcgtcgggttacccgttcgttaacgtccgaccggtaacccgaacgggtccgttcccgtaacccccgttcggtaaccccg

SEQ ID NO: 432408 - DNA, 571 bp, Homo sapiens
  misc_feature: GZ8MTXP01BDOUF.19.85.H08.1.454.CMB.2.raw
  modified_base (224)..(224): a, c, t, g, unknown or other
  modified_base (230)..(230): a, c, t, g, unknown or other
  modified_base (243)..(243): a, c, t, g, unknown or other
  modified_base (246)..(246): a, c, t, g, unknown or other
  modified_base (251)..(251): a, c, t, g, unknown or other
tcagtactctcgtgcacgaccggtgctcgatttagtatcactcagtcggcggggctccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgganaccaanatgcgcacaggancgntggcngcagcaacgcaggccacctccaaactcctgtcgtacaggaatcgacaacccggcctacaaactatttcagtagaacgtacttttacacccgtaccaaggaaaccaacaaatacacgtccctctacagacctacttactagtcctaccgacgaccgtgaacgacgacgggtacctacggacctaactactcgcgtactacgccgacgggaacaccgacgcctcgctgtcttggtcgtttcgggcggttacggaccacggcgtcgttacccggttcgttcgggccacgcccgaagggcccttccggtccccgttcggtcccg

SEQ ID NO: 432409 - DNA, 724 bp, Homo sapiens
  misc_feature: GZ8MTXP01B95J8.19.85.H08.1.454.CMB.2.raw
  modified_base (282)..(282): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgcccacccgtcgggtcggtccgggggcctggggacacggcccgaccacgacgtccaccgtcgaccgaaccgggaaccaaccaaacaagtcggtcggacgaccgagggacgccgngttggctgcagcaacgccgacggcccaaccccgtaccaaactccgtagtaccgtaacgaaggaactacgaaccgaaaccccggtccctaacaaaacgttacgtttaccgaaagtagtaacgttaccttttacccgaaccgtacgaaacggaacctaaaaacaaaacttcgacgtcccttacgtactacgaacctaagttccgtcgtactaccacgtaccgtaggaaccgacgtacggtctacgaccttacgtacgtcgcctacggacggtaccgtacggacccacgtaccgcccgtcgtctcggtcgttcgggttccgtttcgggaaccgggtaacggttaccgtaaacggttccgttacggtacccgttccgggttcgggaccgaacccggaccgtaacggtcccgtacccggttccccgttcgttcccgtttaaccccgg

SEQ ID NO: 432410 - DNA, 558 bp, Homo sapiens
  misc_feature: GZ8MTXP01DHYNI.19.85.H08.1.454.CMB.2.raw
  modified_base (250)..(250): a, c, t, g, unknown or other
  modified_base (392)..(392): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtccgggggcctgggacaggccgccacagtcacctgcaccggaacacaacatgcgcgaccagggagccgntggctgcagcacgccagggcccaccctccaaactcctgtcgtacaggaatcgaaccaaccggtcccctacgaaactatttacagagactactttcactccaagacaaacaaaatcagccctctactacgactattactgtcnccagcctgacgacgacggctacgactactactgcctgacgcgtacggaccaccgacgcctcgctgtcgttcggtcgtttcggcggacggaccgaagcgtcgtccgttaccgttgggttaccaacggacccgaacggtccgtaccggcccctcggttccttaacccg

SEQ ID NO: 432411 - DNA, 605 bp, Homo sapiens
  misc_feature: GZ8MTXP01BRLEL.19.85.H08.1.454.CMB.2.raw
  modified_base (494)..(494): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgcccacccgtcgggtcggtccgggggcctgggaccacggcccgccacagtccacctgaccgaaccgggaacaaccaacaagtgtccgggacgaccgagggacgccgtcgttggctgcagacaacgccgacggcccacccctcccaaactcctcgtcgtacaggaactcgaccaacccggcctacaaactattacagacgtacgtacttttcacctacaggaaacaacaatacacgtcctactctacgacctattacgtcgtctaccgacgccgtagacgacgacggctacgactactacgtcgcgtacacggccgtacgggaccnccgacgcctcgctcgtcgttggttcgttttgggcgacgggtaccacgtcgtcggaccggttccgttcgggtccgcggaaccgtacggccttccgtccccgttcgtaacccg

SEQ ID NO: 432412 - DNA, 770 bp, Homo sapiens
  misc_feature: GZ8MTXP01BBMN6.19.85.H08.1.454.CMB.2.raw
  modified_base (212)..(212): a, c, t, g, unknown or other
  modified_base (295)..(295): a, c, t, g, unknown or other
  modified_base (597)..(597): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctcgaccctcctcactcactctgcagtgtcagtggtccaggcaggactgactcacgccacccgtcggtcggtccggggccgtgggaccacgggcccnccgacacgtccaccgtcgaccgaaccgggaaccaaccaaacgaagttcggacggaccgaccgaggggacgccgtcgttcggcngcacgaccgaacccgccgaacggccccaacccctacccgaaacctcctcgtaccgtacgaggaactacgaaccgaacccgtccctaacaaactacgtttacaacgtacggtaaccttacctttacgtaacccgtaccgaacggtaaaaccaaactaaacgtccaaacgtcccttacctaccgtacgtaaccctaagtttaaccgtccgtaccttaccgacgtacccgttagggaacccggaacggtcggtacctaacgtacgttactaacgtcgacgtacgtacggtacctaccgggaaccnccgtaaccgtccgtaccgtcgtccggttacgttccggttccggtttaacggccgggaaacggtaaccgttaacggtacccgttcgggaaccccgtttcggttaccggggtccgaacccggtcccgtaaacggggtcccgttaccccggtaacccccggttcgttaacccccgg

SEQ ID NO: 432413 - DNA, 758 bp, Homo sapiens
  misc_feature: GZ8MTXP01AMP3M.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccgggggcctggggacacggccgccacacgtccaccgtgaccgaccgggaacaccaacaagtggtcggacgaccgaggggacgccgtcgttggctgcgagccaacgccgacgggaccccacccctacccgaaactccgtacgtacgtaacgaggtaactacgaacccgaaccccggtcccctaacgaaaaccttacgttttaccgaaggtaacgtaacgtttaaccctttttacccgtaaccgttacccgaaacggtaaacccaaaaaactaaaaaccgtttaacccgaacgtaccccttaccttaccgtaccggtaaacccttaacgtttacccgttacggttacctacccgtacgtacccgttacggaacggtacggacggtacctacgtaaccttacctacgtacgtccgtacgaacgtcccgtacgggacccaaccgccgtccgtcgtccgtacggttcgttcggttccgtttcggggcggtacggttaccgacgttccgtcggtacccgttcggttcgggccgtaacggcccaacggtccgtcccggttccccgtcggttccctcccg

SEQ ID NO: 432414 - DNA, 709 bp, Homo sapiens
  misc_feature: GZ8MTXP01B8BKN.19.85.H08.1.454.CMB.2.raw
  modified_base (249)..(249): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggcccaggcaggactgactcagccaccctcggtcggtccgggggcctggggacaggccgcacagtcactgcaccggaacaccaacaatgcggcgaccaggganccgctggctgcagcgaacgccacgggcccacccctacccaaactccgtagtaccgtaacgacggaaacttcggaaccaaaccccgggtaccccttaacgaaaacctacttttacgaaaggtaagacgttaaacttttttcccaacccgttacccgaaagggaacccaaaaaaccgtaaaaaaacttccgaacgtaccctcgtaccttacgaacccttagttacctacggttactacccagaccctagaaccggtaacggacgggctacggacttaacgacgttgacctacgtacggacccgttcgggaacctaccgaccgtcccgttacgcctcggtccttgggttccgtttacggggcgggtaacggaccgaaacggttccgtacggtaccgttccggttcggttaccgaacgacccgaacgggtcctacccgggccccttaaccgggttcctaacccg

SEQ ID NO: 432415 - DNA, 639 bp, Homo sapiens
  misc_feature: GZ8MTXP01AUAMC.19.85.H08.1.454.CMB.2.raw
  modified_base (329)..(329): a, c, t, g, unknown or other
  modified_base (367)..(367): a, c, t, g, unknown or other
  modified_base (410)..(410): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctctcactcactctgcagtgtcagtggtccaggcaggactgactcacgcccacccgtcggtcggtccgggggcctggggaccaggcccgccacaggtccaccgtgaccgaacccggggaacaaccgaacaagtcggtccgggacgaccgaggggacgccggcgttggctgcacgcaaccgccgacgggccccacccgtcccaaactccngtacgtacaggaactcgaccgaaccggccctacaaacntttacagagactactttcactcgacgacaaacaaactcgaacncctactcacgtacctattaccctgtacctccaacgtcccgagaccggacgcgtactacgactactactctcgtacgacggccgtcgggaccaccgctaccgtcgctcggtcgttcggtccggtttacgggcgggaacggaccgtaacgcgttacggacccgggttccgttacggggccaacggacccgaacggtcccgtccggttcccccgttcggcccgttaaccccg

SEQ ID NO: 432416 - DNA, 559 bp, Homo sapiens
  misc_feature: GZ8MTXP01AMTKC.19.85.H08.1.454.CMB.2.raw
  modified_base (341)..(341): a, c, t, g, unknown or other
  modified_base (429)..(429): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttcctgtcgctattttagcaggtgtccaatgtgaggtggagttggtggagtcgtgggggaggcttggttcagcctggagggtccctgagagtctcctgcacagcctctggattcacttcagtaactatgagatggactggatccgcaggctcgaggaagggctggagtggattgcctatgtcactagngaggcaagtcacgtctacggcggactcgtggtcggcggggtcccgtttacactctccagagacaagtcgacaagaagacgctctttcnggtactaagttggacggccgtgagacgtacgaacgacgacggtcttatttaattacttggtgttggaggagggttcggggggcttaccggtgggcgtggggtacgggtcgttagttcgttttgttaaggg

SEQ ID NO: 432417 - DNA, 605 bp, Homo sapiens
  misc_feature: GZ8MTXP01CLNC5.19.85.H08.1.454.CMB.2.raw
  modified_base (410)..(410): a, c, t, g, unknown or other
  modified_base (419)..(419): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgcttgggttttcctgtcgcctattttagcaggtgtccaatgtgaggtggagttggtggagtcgtgggggagtcttggttcagccgtgggacggtccctgagagtctcctgcacagcctgtggattccaccttcaagttaaactatggagagtggactggactcccgccaggcctccgaagggaaagggctgggagtggattgcctatgtcacgtggagagggacagtccacgtcctagcgacttcgtggcggcgggtccgttacnctctcaganacaatcgacaagaacgtacgtcttcttctcggactaaggttcggacggtcctgagtacgtacgaagtaccgtacggtacttaattttaacgtacgttggttaggttaggagggtaggggacgggggcttaccgggttgggacggtttcggggtcgggttcgttagtttcgttttgggtttaacggg

SEQ ID NO: 432418 - DNA, 717 bp, Homo sapiens
  misc_feature: GZ8MTXP01DC36T.19.85.H08.1.454.CMB.2.raw
  modified_base (588)..(588): a, c, t, g, unknown or other
tcagtactctcgtgcacgaccggtgctcgatttagtatcactcagtcgcggggctccaaacagagcttcagcaagcatagtgggaatctgcaccatgccctgggctctgcctcctcctgaccctcctcactcactctgcagtgtcagtcggtccaggcaggactgacctcagcccacccgtcgggtcggtccgggggcctgggaccgacggccgaccacgacgtccaccgtcgaccgaacccgggaaacaaccaaacgaacgttcggaccgggaccgaaccggaggggacgcccggtcgttcggctcggacacggacccgaaccggcccgaccggacccccaacccctacccgaaacctccgtacgtaccgtacgaaggaactaccgaacccgaaccccggtccctaactaaactctttacgaagtagtaccgtttacctttacaccctacgacgtaaaaccaaataacgtccacgtccttacactacgacccttattacgtcgtacctacgacgtaccgtagaaccgggacgtacggtactacggaaccttactacgtctcgtaccgacgtccgtacgacctaccgngtaccgtcgtctacggttccgtcgggttccggttaacggggaacggacggtaccgacggtccgtccggttacccggttcggttacgccgaccgcccgtacgcccgttacccgtccccgttcgtaacccg

SEQ ID NO: 432419 - DNA, 853 bp, Homo sapiens
  misc_feature: GZ8MTXP01B8G4E.19.85.H08.1.454.CMB.2.raw
  modified_base (272)..(272): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtggtcccgggggcctggggacacggccgccacagtcacctgaccgaaccgggaacaccaaacaagtcggtcggacgaccgaggggacgccgntggctgcagcaacgccacgggccccaccctcccaaactcctgtcgtacagggaactcgaccaacccggccctacaaactatttacgagagacgtactttccactcaacggacaaacaaaacgtccacgtacccttactacgtacgtaacctaatttaccgttacggtaccttacccgacgtacccgttacggaacccggtaaccgggtaacggtaccgttaaccggtaaccttaaccgttaaaccgttccgggtaccctaccggggtaccgggtacccggttaccgggggaaccctaaaccccggtaaccgtaccccggttaccggtacccggttccggttcccgggtttaccggggtttccccgggttttttaccggggggaaccccgggggttaaaccgggggttaaccccgggttaaacccgggttacccgggttaaccggggtaacccccgggtttcccggggtttacccgggggtttaaccccgaacccggggtaccccccgggttaaaccggggtccccggttaccccggggttcccccccggtttaacccggggttccccgtttaacccccggg

SEQ ID NO: 432420 - DNA, 573 bp, Homo sapiens
  misc_feature: GZ8MTXP01EBGBG.19.85.H08.1.454.CMB.2.raw
  modified_base (237)..(237): a, c, t, g, unknown or other
  modified_base (256)..(256): a, c, t, g, unknown or other
  modified_base (261)..(261): a, c, t, g, unknown or other
  modified_base (323)..(323): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccacccgtcggtcggtccgggggcctgggacacggccgccacagtcacctgccaccggaacaccaanaatgcgcgacaggagccgntggcngcagcaacgccacggccaccctccaaactcctgtctacagaatcgacaccgcctacaaactnttcagatacgtatttacacctcaagaaccaacaaactacactcctactctacgacctaattacgtcggtcctaccacgtacctacgacgaacggacgctacgaactactactcgtactcgacgccgtacggcctaaccgcgcctcggctcgtcgttggtccgtttaacgggcggttacgggaccaacgtccgtcggaccgttcgttcgggtccacggaaccgacgtccgttccgtccccgttcgtccccg

SEQ ID NO: 432421 - DNA, 794 bp, Homo sapiens
  misc_feature: GZ8MTXP01CXDFY.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcgggtcggtcccgggggcctgggacacgggccgaccacacgtccaccgtcgaccgaaccgggaacaaccaaacgaacgtcggtaccgggaccgaaccgaggggacgcccggtcgttcgggctgcacggaccaaccggcccgaacggggccccaaccccgtacccaaaaccttcccgtacggtaccgtaacgaacgggaaactcggaaacccaaaccccgggtaccccttaacaaaaaccgtatttaccgaaggtaacgtaacgttaaccctttttacccaaacccgttaccgaaacggaaacccaaaaaacctaaaaaactcctaaaccgtcccttaacccttacctaacggtaacccctaagtttaaccctacggtttaccaccccgtaacggtccctacggaaccggaaaccggtacgggtacctaacggtaccctttaaacgtaaccgtggtacccttaccggaacggtcccggttaacgggaccctaccgaccgtccgtcgtaccgttcggtccgtttacggtccgtttcggggaacggacgggttaccaacgttcgacggtccgttcgttcggcaacgcccgtaaggcctacgcccctcggttcctaacccg

SEQ ID NO: 432422 - DNA, 738 bp, Homo sapiens
  misc_feature: GZ8MTXP01EVNKZ.19.85.H08.1.454.CMB.2.raw
  modified_base (258)..(258): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgcccacccgtcgggtggtccggggcctgggacacggccgccacacgtccacctgcaccggaacaccaacatgacggcgatcgagggacnccgcttggctgcagccaacgccacggcccaccctacccaaactcctgtacgtacgaaggactacgaacccaacccggtccctacaaacctatttacacgtaacgtacgttacttttaccgaaccctaccgaaacgaaacctaacctaaaaactaccgacccgtacccttaccttacgtacgtaacccttacgtttaccgttacggtacctacccgtaacggtcccgttaacggaaccggtaacggaacgggtacctacggtaaccttaacttaccgtacggggtaccttaccgaccggtacccgttacggggaacccaacccgttaacgacccgtccggtcgttcggtccgtttcgggtccggttttacgggaccgggtacgggacccgaaacggtccgttacggttaccccggttccggttaaccgggtaccgtaaccggacccgtacgggttccgtccccggttcccccgttcccggg

SEQ ID NO: 432423 - DNA, 487 bp, Homo sapiens
  misc_feature: GZ8MTXP01E1W4N.19.85.H08.1.454.CMB.2.raw
  modified_base (242)..(242): a, c, t, g, unknown or other
  modified_base (257)..(257): a, c, t, g, unknown or other
  modified_base (262)..(262): a, c, t, g, unknown or other
  modified_base (264)..(264): a, c, t, g, unknown or other
  modified_base (266)..(266): a, c, t, g, unknown or other
  modified_base (275)..(275): a, c, t, g, unknown or other
  modified_base (278)..(278): a, c, t, g, unknown or other
  modified_base (281)..(281): a, c, t, g, unknown or other
  modified_base (284)..(284): a, c, t, g, unknown or other
  modified_base (365)..(365): a, c, t, g, unknown or other
  modified_base (367)..(367): a, c, t, g, unknown or other
  modified_base (369)..(369): a, c, t, g, unknown or other
  modified_base (371)..(371): a, c, t, g, unknown or other
  modified_base (373)..(373): a, c, t, g, unknown or other
  modified_base (375)..(375): a, c, t, g, unknown or other
  modified_base (377)..(377): a, c, t, g, unknown or other
  modified_base (379)..(379): a, c, t, g, unknown or other
  modified_base (381)..(381): a, c, t, g, unknown or other
  modified_base (385)..(385): a, c, t, g, unknown or other
  modified_base (389)..(389): a, c, t, g, unknown or other
  modified_base (393)..(393): a, c, t, g, unknown or other
  modified_base (395)..(395): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (403)..(403): a, c, t, g, unknown or other
  modified_base (409)..(409): a, c, t, g, unknown or other
  modified_base (411)..(411): a, c, t, g, unknown or other
  modified_base (417)..(417): a, c, t, g, unknown or other
  modified_base (419)..(419): a, c, t, g, unknown or other
  modified_base (421)..(421): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (431)..(431): a, c, t, g, unknown or other
  modified_base (435)..(435): a, c, t, g, unknown or other
  modified_base (437)..(437): a, c, t, g, unknown or other
  modified_base (439)..(439): a, c, t, g, unknown or other
  modified_base (441)..(441): a, c, t, g, unknown or other
  modified_base (443)..(443): a, c, t, g, unknown or other
  modified_base (445)..(445): a, c, t, g, unknown or other
  modified_base (449)..(449): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccgggaacaccaacatgtcggcaccnggagccgcttggctncgacncncncgcgcgccnccnccnccnctaccgtctacgacgacgacgacacgaccaccgacctactaactatcacgtatactacttacctaccaacgaacgaacacncncncncncncncncnctcnctcnctcncncncncncncgcgcncncgctcncncncncncncncnctcncncncncncnctcncgtcgtcttcgcgcgcgcgtcgtcgtcgcgtcgcgtcg

SEQ ID NO: 432424 - DNA, 743 bp, Homo sapiens
  misc_feature: GZ8MTXP01EYPMO.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccggggcgtgggacacggccgaccacgacgtccaccgtgaccgaacccgggaacaccaaacaagtcggtaccggacgaccgaggggacgccgtcgttggctcgacacgaccaaccgccgacgggccccaccccgtacccaaaccgtcctcggtacgtaacgaggaactacggaacccgaaccccggacccctaacgaaacctagtttaccgaagtacgtacgtttaacctttttacccaaccgtaccgaacggtaaaccctaaaaacctaaaacttccgacgtacccttacccgttaccgtaactaacccgttaaacgtttacccgttacggttacctaccgtaccgtccgtacggaccgaacggtacgtaccgtacggtaacttaccgtacgtacgtaccgtacggacgtaccggtacggaccgacccgacgtcccgtcgtcgtcggtcgtttcggtccggtttacgggccgggtacggaccgacgttcgtaccgtccgttcggttcggttccgaaccgccggaacgtccgtacccgcccgtccggttctaaccccg

SEQ ID NO: 432425 - DNA, 617 bp, Homo sapiens
  misc_feature: GZ8MTXP01BJTHI.19.85.H08.1.454.CMB.2.raw
  modified_base (268)..(268): a, c, t, g, unknown or other
  modified_base (273)..(273): a, c, t, g, unknown or other
  modified_base (304)..(304): a, c, t, g, unknown or other
  modified_base (329)..(329): a, c, t, g, unknown or other
  modified_base (335)..(335): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgcccacccgtcgggtggtccgggggcctggggacacgggcccgccacagtccacctgaccaaccggaacaccaacagtgcggacgacgagggacgccgntggcngacagaacgcaggaccacccctccaactccngtacgacagatcgacaccgccctanaaactnttacagagtacgtactttaccacctacgagaaccaaacaaactcacgtccctactactacgacctagtttacccgtcgtacctaccacgccgtagaccgaacggtacggtactacgtaccttacgtacgtcgacctacggacgtcccgtacgggacctaccgacgtccgtcgtcgtcgtcgtttcgtccgtttcggggaacggacggacgtacggccgtacggtacccgttcggttcggacctaaccggcctaacggcctccgaccccgtcgttccgtcccg

SEQ ID NO: 432426 - DNA, 683 bp, Homo sapiens
  misc_feature: GZ8MTXP01CIW2M.19.85.H08.1.454.CMB.2.raw
  modified_base (662)..(662): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtcggtccgggggcctgggacacggccgccacagtcacctgccaacccgggaacaccaacaatcggtcggcgaccgagggacgccgcgttggctgcagcaacgccagggcccacccctcccaactcctgtcgtacaggaactcgaccaacccggcccctacgaaactactttacgaagtagtacgtacctttttacctaccttacccgaacgggtaaaccaaaacctaaaaacgttaaccaaccggtacccttaccttaccgtacgtaacccctaaacttttaccgtacgggttacctacccgtaacgtacccgttacggaaccggtaacggtacgggtctacggtaccttaacctaacgtcgtacctacgggacgtccgttaccgggacccaaccgtacgcccgtcgctcgtcgttcggtcgtttcgggcggtacgggaactacggcgtaccgtacgttccgttgggttcaacgccgaacgtcnccgccccgtcgccgtaacccg

SEQ ID NO: 432427 - DNA, 572 bp, Homo sapiens
  misc_feature: GZ8MTXP01DXFJ6.19.85.H08.1.454.CMB.2.raw
  modified_base (200)..(200): a, c, t, g, unknown or other
  modified_base (336)..(336): a, c, t, g, unknown or other
  modified_base (420)..(420): a, c, t, g, unknown or other
  modified_base (527)..(527): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtgtccaggcaggactgactcagccaccctcggtgtccggggcctgggacaggccnccacagtcacctgcaccggaacaccaacaatgcggacgaccagggagccgcttggctgcagcaaacgccacgggcccacccctcccaaactcctgtcgtacaggaatcgacaaccggccctacaaacatttcaganagtactttccactcagacaaacaaaatcagccctctactacgaccattactgtctccagcctgacgacgagctgactactactnctcgacgcctagggaccaccacgccgtcgtcgtgtccgttcggtcgttttccgggcgggtaacggaccgtaacgttccgtcggtaacccgttccgttcgggttaccnccggacccgaacggcctccgcccccgttcggttaacccgttcccg

SEQ ID NO: 432428 - DNA, 548 bp, Homo sapiens
  misc_feature: GZ8MTXP01AZQZ3.19.85.H08.1.454.CMB.2.raw
  modified_base (228)..(228): a, c, t, g, unknown or other
  modified_base (244)..(244): a, c, t, g, unknown or other
  modified_base (248)..(248): a, c, t, g, unknown or other
  modified_base (279)..(279): a, c, t, g, unknown or other
  modified_base (309)..(309): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctctcactcactctgcagtgtcagtggtccaggcaggactgactcagcccacccgtcggtgtccggggcctggggacacggccgcacagtcacctgcaccggacacanagtgtcgcaccagganccgntgctgcagcaacgcacggtccacctccaacnctgctacaggaactgacaccgcctacaacnttcagtagcgtactttcactacgagactaaacgaaactcaacgtcctacgtctacgacctattacgtcgtctccgagtctcgacgacgacggtactacgactaccgtatcgtacctacgacgccgtagggaccaccgcggcctcgtcgtcgtcgttcgtaccgttcgggcggtacggacctacggcgtacgccgttcggttggttcaacgtccgaagtcctcgcccgtaacgcgtaacc

SEQ ID NO: 432429 - DNA, 866 bp, Homo sapiens
  misc_feature: GZ8MTXP01BFRZT.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgcccacccgtcgggtcggtccgggggcctggggacacggcccgccacagtccaccgtgaccgaaccgggaacaccaaacaacgtcggtccggacgaccgaggggacgccgtgttggctgcagacaaccggccacgggcccaccccgtaccaaacctccgtagtaccgtaacgacggaacgtacgaaccgtaacccggacccctaacaaacgtactttacgaagagtacgtttacccttttaccctaccgtaccgtaacggaaccaaaactaaaaacttccgacgtacccttactaccgtacgaacctagtttaacccgttcggtacctacccgacgtacccgttaacggacccggtaacggaccgggtacctacggtaaacccgttaaccttaccgttacgtaccccgtaaccgggtaccgggtacccggttaaccggggaaaccctaaccccgaaccggggttcccccttacgggttaccggttccggtttcccgggtttaccgggggtttccccggtttttacgggggaacccggggttaaacccggggaaacccggtaaacccggttcgggttaccccgggtaacccggttcccggggttacggggttacccgaacccggggttaccccgaaaccgggttcccccggttacccggttcccccccggtttaacggttcccccggtttaacccccgg

SEQ ID NO: 432430 - DNA, 673 bp, Homo sapiens
  misc_feature: GZ8MTXP01B10BJ.19.85.H08.1.454.CMB.2.raw
  modified_base (293)..(293): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgcttgggttttccttgtcgcttattttagcaggtgtaccaatgtgaggtggagttggtggagtcgtgggggagcttggtcagccgtggacgggtccctgagtacgtctccgtgcacgacgtcccttcgtaggtacttccaaccctttnaagttaactagttgagtagtggtaactggactcccgacgacggtactccgaaggggaagggctgggagtggattcgcctatcgtacacgtggtgagggactacgtccgacgtccgtacgcgtactcgtggtcgggcggggtacccttacacgtcctacgagtacgaactaagtccgaacgtaacggaacgtaccgttccgttactttccgtacggacgttaacggttcgggaccggtacctaggaccggtaaggtaccgaaaggtaccgtacggttacttaagtttaacgtttaacgttggttgttacggaagggaggggacgggttccgttacggtggtcgggtcggtttacgggcgttagtttcgttttggttaacgg

SEQ ID NO: 432431 - DNA, 649 bp, Homo sapiens
  misc_feature: GZ8MTXP01B6GRJ.19.85.H08.1.454.CMB.2.raw
  modified_base (201)..(201): a, c, t, g, unknown or other
  modified_base (282)..(282): a, c, t, g, unknown or other
  modified_base (448)..(448): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttgggttgtgcttgggttttccttgtcgcttattttagcaggtgtccaatgtgaggtggagttggnggagtcgtgggggagcttggttcagccgtggacggtccctgagtagtctcctgcacacgcctgtaggacttccaccctttnaaacgttaactagttaggagtagtcggtaacgtggacgtccccgaccgaggtccctaccggaaggggaaacgggggtctagggacgtggtagttcgacctagtcgtacacgtaggtgaggactagtcacgttccgacgcgactcgtggtcggccgggtcgttaccntcctacgagactacgaagtcgaacgaaagacgacgtcttactttcgacggacttacggttcgggaccgtacgtacgggacgtaaggtaccgaagtccgtacgtactttagtttaacgttacgttggttagaggtaggacggggttgggttccgaggttggacgttggggtccggtgttaccgtttgtttaaggtttaaggg

SEQ ID NO: 432432 - DNA, 591 bp, Homo sapiens
  misc_feature: GZ8MTXP01B4G2L.19.85.H08.1.454.CMB.2.raw
tcagtactctcgtgcacgaccggtgctcgatttagtatcactcagtcgcggggtctcagagaggtgccggttagtcctggagtccaaggcacttccacttggtgatcagtactgaacacagaggactcaccatggagttggggttgtgcttgggttttccttgtcgctattttagcaggtgtccaatgtgaggtggagttggtggagtcgtgggggagtcttggttcagccgtggaggtccctgagtgtctcctgcacagcctctggattcaccttcaagtaactatgagatggactggactccgcgaggcctaccgagggaaacgggctgggagtggtattcggccttagtcgtacaccgtaggtggacggggcaagtccaccgtccgtacgccggtactcgtggtcgggcggggtcccgttaccatcctcgagagacaagtcgacaagacgtacctcttcttcgtgtacgtagtcggacgcgtagacgtagacgaagacgtacgtacttagtttaattacttggtgttggaagggtggggagggggttcaggtcggtagttgggtcggtcgttgttgtttcgttaaggg

SEQ ID NO: 432433 - DNA, 617 bp, Homo sapiens
  misc_feature: GZ8MTXP01ATBMD.19.85.H08.1.454.CMB.2.raw
  modified_base (253)..(253): a, c, t, g, unknown or other
  modified_base (259)..(259): a, c, t, g, unknown or other
  modified_base (373)..(373): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacctcggtgtccgggggcctgggacaggccgccacagtcacctgcaccgggaacacaacaatgtcggcgaccagggagccgnttggcngcagcaacgccgacggccaccgtccaaactcctgcgtacaggatcgaccaacccggcctacaaactattcagtacgacgtacttttcacctccaaggaaccaacaaacgtcacnccctctactgacctattactcgtctacacgcctagacgacgaggactgacctactacgcactcgaacgtccgacgggaccaccgacggtcctcgccgttcggtaccgttcgggttcccgttttcggggacccgggagggtaaacccaacggtacccgtcggttaacccggttccggttacgggggttcccacgggtaaccccgaaggtccccgttccggtaaccccccgtttcgggtaaccccg

SEQ ID NO: 432434 - DNA, 790 bp, Homo sapiens
  misc_feature: GZ8MTXP01BMFDU.19.85.H08.1.454.CMB.2.raw
  modified_base (178)..(178): a, c, t, g, unknown or other
  modified_base (236)..(236): a, c, t, g, unknown or other
tcagtactctcgtgcacgaccggtgctcgatttagtatcactcagtcgcggggtcagagaggtgccttagtcctggagtccaaggcacttccacttggtgatcagtactgaacacagaggactcaccatggagttggggttgtgcttgggttttccttgtcgcttattttagcaggtntccaatgtgaggtggtagttggtggagtcgtgggggagtcgttggttcagccgtgggnggtccctgagtagtctcctgcacacgtccctcgtggtacttcctaccttcgaagtaactagtagagagtggactggactcccgtacgacggtacctaccggaagggggtaaacgggggtcttagggggaggtcgggtaattcgtaccttagttcgtaactacgttaggtacgggaacggggtacgtaaacggttcccgtaaaccggttcccgttaacgggccggtaaacccgttcggtacggggtccggggtcccggggggttacccgttttaaccgcgttaccgtacccgaaggtaacgaaacctaagttaccggaacccgtaaaaggtaaccggtaccgtacgtttacctttacggtacggtaacggtaacgggtttaccggggaccggtaccgtacggaaaggtcggttaacggaaacggtaccgtaacgggttacctttaagtttaacgttggtaggttggtacgggaagggtaggggacgggggttccttgggttcggcggttcggggttcgggtcgttagtttcggtttaaggttcggtttaacgggg

SEQ ID NO: 432435 - DNA, 511 bp, Homo sapiens
  misc_feature: GZ8MTXP01B21LI.19.85.H08.1.454.CMB.2.raw
  modified_base (283)..(283): a, c, t, g, unknown or other
  modified_base (344)..(344): a, c, t, g, unknown or other
  modified_base (391)..(391): a, c, t, g, unknown or other
  modified_base (396)..(396): a, c, t, g, unknown or other
  modified_base (398)..(399): a, c, t, g, unknown or other
  modified_base (403)..(403): a, c, t, g, unknown or other
  modified_base (407)..(407): a, c, t, g, unknown or other
  modified_base (413)..(413): a, c, t, g, unknown or other
  modified_base (416)..(416): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtggggagcttggtcagcctggaggtccctgagagtctcctgcacagcctctggattcaccttcagtaactatgagntggactggactccgcaggctccgaggaaagggctgagtcggattgcctatgtccacttagngagggcagtcacgtctagcgactctgtgcgggtacgttacatctcanagaanannacanaganctcttntgnagtgacgcgtgagagacgagtacgacgtactattaattacttgtgttgagaggaggggcgcgtggtcgtcggtcggtcgttacgttcgtttgttg

SEQ ID NO: 432436 - DNA, 536 bp, Homo sapiens
  misc_feature: GZ8MTXP01EJ3MZ.19.85.H08.1.454.CMB.2.raw
  modified_base (247)..(247): a, c, t, g, unknown or other
  modified_base (264)..(264): a, c, t, g, unknown or other
  modified_base (290)..(290): a, c, t, g, unknown or other
  modified_base (422)..(422): a, c, t, g, unknown or other
  modified_base (495)..(495): a, c, t, g, unknown or other
tcagtactctcgtgcacgaccggtgctcgattttagtatcactcagtcgcggggtctcagagaggtgccttagtcctggagtccaaggcacttccacttggtgatcagtactgaacacagaggactcaccatggagttggggttgtgcttgggtttttccttgtcgcttattttagcaggtgtccaatgtgaggtggagttggtggagtcgtgggggagcttggttcagccgtggagggtcctgagngtctcctgcacagcctntggattcaccttcagtaactatgagntggactggactccgcaggctcgaggaaagggctggagtgatgctatgtcactgtgaggcaagtcacgtccacgcgactctgcggcgggtccgttacatctcagagacaatcgacaagaagacgtctactttncggtactaagttggacggtccgtgagacgtacgaagtacacggtacttattaattacttggtgttgaggaggnggggcacggtggcgtgggtcggtgttattcgtttgtaacgg

SEQ ID NO: 432437 - DNA, 576 bp, Homo sapiens
  misc_feature: GZ8MTXP01EU6ZH.19.85.H08.1.454.CMB.2.raw
  modified_base (337)..(337): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttgggttgtgctgggttttccttgtcgctattttagcaggtgtccaatgtgaggtggagttggtggagtcgtgggggagcttggttcagccgtggaggtccctgagagtctcctgcacagcctctggattcaccttcagtaactatgagatggactggatcccgcaggctccgaaggaaagggctaggagtggattgcctangtcactaggtgaggcaagtcacgtcctacgcgggtactcgtggtcggcggggtacccgttacatctccagagacaatgaccgaaagaagaccgcttactttctgggacgtaagttcgggaacggtcctgagacggtacgaagtacgacggtcttaagtttaattaacgttggtggttgaaggtacgggagggggcacgtgggcgtcggggttcgggtcgttagtttcgttttggtaagg

SEQ ID NO: 432438 - DNA, 787 bp, Homo sapiens
  misc_feature: GZ8MTXP01D97N7.19.85.H08.1.454.CMB.2.raw
tcagtactctcgtgcacgaccggtgctcgatttagtatcactcagtcgcggggtcagagaggtgccttagtcctggagtccaaggcacttccacttggtgatcagtactgaacacagaggactcaccatggagttggggttgtgcttgggttttccttgtcgcttattttagcaggtgtccaatgtgaggtggagttggtggagtcgtgggggagtcttggttcagtccgtgggacggtccctgagtagttcttctgcacacgtcccttcgtggtattccacccttcaagtaactatgagtatggactggactcccgaccgaggtcctaccggaaggggaaacgggggtctagggaggtagggtattcggccttaagtccgtaccctaaggttaggtcgggaaggggtaccgtaaacgtcccgaaacccggttcccgtaaccgggcggtaaccgttcggtcggggtccggggtacccggggggttaccccgttttaacccacttcccgtacccgaaaggaacgaaccgtaaagtaccggaaccgtaaacggtaaaccgtaccggttacctttaccgttttcgtacgtaacgggttaaacggttaccggggtaacccggtccgtaggaacggtaacgtaacggaaaacggtacgtaaccggttactttaagtttacgttaacgttgggttagttaggttaaaggtaggggaacgggggttcttacgggttcggtaacgggttcgggtcgggttcgtagtttacgttttgggttaagttttaacggggg

SEQ ID NO: 432439 - DNA, 724 bp, Homo sapiens
  misc_feature: GZ8MTXP01CJNJL.19.85.H08.1.454.CMB.2.raw
  modified_base (277)..(277): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctctcactcactctgcagtgtcagtcggtccaggcaggctgactcagcccacctggtcggtcccgggacctgggacacggccgaccacgagtccaccgtgaccgaaccggaacacccaaagagtcgtccgggacgacgagggcgccgtgttcggcngaccgagaccgaccgccgaccggtacccaaccgtacctaacccctaaacgttcccgagttaccggaacgaacgggtaacacccggaaaccccgtaacccggtccccttaaacgaaacttacgtttacgaacgtacgttacttacttttaccacccgaacgaaacgaaccaacgtaaactaccgtacgtccctataccctacgtaaacccttacgtttaaccgtcggtacctacccgaacgttcccgtacgaaccggtacggacggtaccctataaaccgttacgttaccgttggaccccgtacggttaccgacccggttacgaaacccgttccgacgtccccgttgtccgttaacgttccggttcggttcggttacgggacgggtacgacgtacgtcgttccggacgttcgtcgacaaccgcgacgttcccaaccgttccgtaaccg

SEQ ID NO: 432440 - DNA, 681 bp, Homo sapiens
  misc_feature: GZ8MTXP01AI2FQ.19.85.H08.1.454.CMB.2.raw
  modified_base (636)..(636): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgcttgggttttccttgtcgcttattttagcaggtgtccaatgtgaggtggagttggtggagtcgtgggggagtcttggttcagccgtgggagggtccctggagagtctcctgccacacgcctctggacttcaccttcaagtaactatgagtagtggactggactcccgacgacggctaccggaaagggaaacgggcgtaggagtggtattcgaccttagtcgtactaaccgtggtaggacggggacgtaaacgtccgaacccggttcccgtaccggtacccgggtacttccgggtcgggttaccggggcccgggggtttaccccggtttaccctacgttccgtacccgaaggacgaacgaacgtacgaaaccgaaaggaacgaccgtcttacgtttcgcggtacgtaggttaccggacgtccgtagacggaacgtacggaacgtacgtacggtacttattaattacgttgtggttgaggtgggagggggcncggtggtcggtcgggtcgggtcgttagtttcgtttggttaacggg

SEQ ID NO: 432441 - DNA, 723 bp, Homo sapiens
  misc_feature: GZ8MTXP01B5L0W.19.85.H08.1.454.CMB.2.raw
  modified_base (274)..(274): a, c, t, g, unknown or other
  modified_base (279)..(279): a, c, t, g, unknown or other
  modified_base (347)..(347): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgcccacccgttcgggtcggtcccgggggcctgggaccgacggcccgccacgagtccacctgaccgaaccggaacaccaacagtgcggaccgaccgagggcgccgngtgcngcagcacgcgacggcccaccctccaactctcgtacgacagaatccgaaccacccggtcccacaaactnttacgagtacgtacgttacttttaccacctacgaaggaaccaaacaactacgcgtccctctactacgacctattcgtcgtcctccgacgtccgtggaaccgacggtacgtacgtacgaacccgttaccgtacttaccggccgtacgtaccggtacccggtaaccgggacccctaacccgtaccgtccccgttcccggtccgttccggtttccggttccgggtttccgggtttccgggggaccgggaccggggtacccgttaacggtaacccgggtcccgggttaccccggttccggggtttacccgggtaaccgaacccgggtccccggtaaccgggttccccgcccccggttcccccggttaacgggttcccccg

SEQ ID NO: 432442 - DNA, 648 bp, Homo sapiens
  misc_feature: GZ8MTXP01ALHLH.19.85.H08.1.454.CMB.2.raw
  modified_base (211)..(211): a, c, t, g, unknown or other
  modified_base (238)..(238): a, c, t, g, unknown or other
  modified_base (259)..(259): a, c, t, g, unknown or other
  modified_base (263)..(263): a, c, t, g, unknown or other
  modified_base (268)..(268): a, c, t, g, unknown or other
  modified_base (310)..(310): a, c, t, g, unknown or other
  modified_base (331)..(331): a, c, t, g, unknown or other
  modified_base (337)..(337): a, c, t, g, unknown or other
  modified_base (636)..(636): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtgtccaggcaggactgactcacgcccacccgtcggtggtccggggcctgggacacggcccgccanacgtcacctgaccaccggaacaccaanagtgaccggcgacgagggacnccgntggcngcacgacacgcgacggtcccaccctacaactcgagtacgtanaggactacgaccaccgcctanaaactnttacggagtacgtactaccttttacgacctaccgaagtaaaaccaactaagtccacgtacctcgtaactcgaacctacttacgtcggtacctaccgacgtacccgtaggaacccgacgaccggtacgtacggtaaaccgttacctaacgttcgaccgttacgaaccggtccgtaacgggacccacgactccgtcgtcgtaacggtccgttacggtccgttcgggacgttaggaccgacgtcgccggttccgttacgttcggtaaccgccgaaccggttacggcccttaccgggttcccncggtttaacccg

SEQ ID NO: 432443 - DNA, 565 bp, Homo sapiens
  misc_feature: GZ8MTXP01C8CB4.19.85.H08.1.454.CMB.2.raw
  modified_base (222)..(222): a, c, t, g, unknown or other
  modified_base (224)..(224): a, c, t, g, unknown or other
  modified_base (233)..(233): a, c, t, g, unknown or other
  modified_base (238)..(238): a, c, t, g, unknown or other
  modified_base (242)..(242): a, c, t, g, unknown or other
  modified_base (286)..(286): a, c, t, g, unknown or other
  modified_base (317)..(317): a, c, t, g, unknown or other
  modified_base (373)..(373): a, c, t, g, unknown or other
  modified_base (386)..(386): a, c, t, g, unknown or other
  modified_base (392)..(392): a, c, t, g, unknown or other
  modified_base (429)..(429): a, c, t, g, unknown or other
  modified_base (451)..(451): a, c, t, g, unknown or other
tcagtactctcgtgcacgaccggtgctcgatttagtatcactcagtcgcggggtccaaacagagcttcagcaagcatagtgggaatctgcaccatgccctggctctgctcctcctgaccctcctcactcactctgcagtgtcagtggtccaggcaggactgactcagccaccgtcggtggtccggggctggacagccgcacagtcactgcacggaacacaanangtcgcgacnggtanccgntggctgcagcaacgcaggtccacccgtccaaactctagtccganaggatcgaaccaaacggtccctacaaaactntttacaagtagacgtacttttccactccaaggacaaacaaaatcacggctacgtcncgtaacattacgngttacnccacgaacgcacggacgagtaccagtaacagttaccnacacggacgacgacgacgaccncgcctcgtctcgtcgtcgtccgttcggttttttttttttttttcggacggacgacgcgtcgtccgttcgttcgacgaacgaccgaacgccgcccgttcccgtccgttccgtccg

SEQ ID NO: 432444 - DNA, 525 bp, Homo sapiens
  misc_feature: GZ8MTXP02G630O.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccacccctccaaactcctgtcgtacaggaatgacaaccggccctacaaacatttcagagacgtatttctacctcaggacaacaatacagcctctctgacctattactcgtctccagcctgacgacgagctagactactactgctcacgcctgggaccaccgacgcctcgctgcttggtcgtttcggcggacggtaccgagcgtcgaccgtccgtcggtcgacgacccgacggcctcgccccgtcggtcc

SEQ ID NO: 432445 - DNA, 532 bp, Homo sapiens
  misc_feature: GZ8MTXP02GG47F.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctacaaacatttcagagagatttcacctcaggacacaaaatcagcctctctgaccattactagtctccagcctgacgacgagctgactactactgctcagcctgggacaccagcctcgctgcttggcttttcggcggacgggtaccaaacgtcgtcgtacccgtccgtcgggtccaacggccccgaaaggccttccgccccctcggtcctacccg

SEQ ID NO: 432446 - DNA, 529 bp, Homo sapiens
  misc_feature: GZ8MTXP02I4C0Y.19.85.H08.1.454.CMB.2.raw
  modified_base (290)..(290): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggacaccaacaatgtcggcgaccaggagccgcttggctgcagcaacgccaggccaccctcccaaactccngtcgtacaggaatgacaaccggccctcaaacatttacagagagactttcacctcaggacaacaaaatcagcctctactgaccattactgtctccagcctgacgacgacgctagactactactgctcacgcctgggacaccacgcctcgctcgcttggctttcgggcggtacgggaccaaggctacgacccgtcctgggtccaacggcccgaaaggcctcgcccccgtcggtcctacccg

SEQ ID NO: 432447 - DNA, 525 bp, Homo sapiens
  misc_feature: GZ8MTXP02ISJOT.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactggatccgccaggctccgaggaaagggctggagtggattgcctatgtcactagtgagggcaagtcacgtcctagcggactcgtgtgcggggtccgttaccatctcagagacatcgaccaagaagacgcttctttctgactagttggacggcctgagagtcgaagacacggctatttacttactgtgtagagaggacggggcagtcggcgtcggtcgggtcgagttcgtttagtg

SEQ ID NO: 432448 - DNA, 355 bp, Homo sapiens
  misc_feature: GZ8MTXP02JMAW8.19.85.H08.1.454.CMB.2.raw
  modified_base (353)..(355): a, c, t, g, unknown or other
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagagagggggcactggctggtcgggtcgatcttttgatttgtggggccaaggatcaagcgtctccgtctcttcagcctccaccaagggcccatcggtctcccctggcaccctcctccaagagcacctctggggcacagcggccctgggctgcctggtcaaggactactcccacgagagtactgagcgggctggcaaggcgccatagnnn

SEQ ID NO: 432449 - DNA, 546 bp, Homo sapiens
  misc_feature: GZ8MTXP02ICTG7.19.85.H08.1.454.CMB.2.raw
  modified_base (321)..(321): a, c, t, g, unknown or other
  modified_base (364)..(364): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgctggctgcagcaacgccagggccaccccgtccaaactcctgtcgtaccaggatgacaaccggccctnaaacatttccagagagtactttcacctccaggacacaatacancctactctagacctattactgtctccacgcctgacgacgagctgactactactgctcagcctgggacaccgacgcctcgctgcgtcgtcgttttcggcggtacggggacctaaacggcgtacgaccgtccgtcgggtccgacggacccgaacggccgttcccggcccccgttcgggtccccg

SEQ ID NO: 432450 - DNA, 507 bp, Homo sapiens
  misc_feature: GZ8MTXP02GQ93G.19.85.H08.1.454.CMB.2.raw
  modified_base (324)..(324): a, c, t, g, unknown or other
  modified_base (362)..(362): a, c, t, g, unknown or other
  modified_base (382)..(382): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggacaccaacaatgtcggcgaccagggagccgcttggctgcagcaacgccagggccaccctcccaaactcctgtcgtacaggaatgacaaccggccctcaaacntttcagagagatttcacctcaggacacaaatcagcctntctgacattactgtctccancctgacgacgaggctgactactactgctcagcctgggacaccagcctcgctgcttggctttcggcggtagggaccaagctcgaccgtcgtggtccaagcccgaaggctcgccccgtcggctaccg

SEQ ID NO: 432451 - DNA, 538 bp, Homo sapiens
  misc_feature: GZ8MTXP02F6Y8Y.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggaatgacaaccggccctacaaacatttacagagagtacttttcacctcagacaacaaaatcagcctctctgaccattactgtctccagcctgacgacgagctgactactactgctcacgcctgggaccaccacgccctcgctcgcgttgtcgtttttggcggtacgggaccaaacggcgtacgaccgtccgtcgggtcgaacgcccgaacggcctccgcccccgtcggtcctacccg

SEQ ID NO: 432452 - DNA, 560 bp, Homo sapiens
  misc_feature: GZ8MTXP02J3UJZ.19.85.H08.1.454.CMB.2.raw
  modified_base (349)..(349): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagcttggttcagcctgggagggtccctgagagtctcctgcacagcctctggattcaccttcagtaactatgagatggactggatcccgccaggctaccgaggaaggggctggagtggattgcctatgtcacgtagngagggcaagtccacgtcctacggcggtactcgtggtcggccgggggtacccggtttaccactcctccagacgacaagtcgacaaagaacgacgcttctttcgtgctaagttggacggcctgagagtacgaagacacgtcttatttactacgtgtggtagaggaggacgggggcacggtggtcgtgggtcggtcgtagttcgtttagttagg

SEQ ID NO: 432453 - DNA, 520 bp, Homo sapiens
  misc_feature: GZ8MTXP02JOXUC.19.85.H08.1.454.CMB.2.raw
  modified_base (332)..(332): a, c, t, g, unknown or other
  modified_base (408)..(408): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccacccctccaaactcctgtcgtacaggatgacaaccggccctcaaacattcaganacgatttcactcaggacacaatacagcctctctgaccattactgtctccagcctgacgacgaggctgactactacngctcagcctgggacaccgagcctcgctcgcgttgcgtttcggcggtacgggaccacggctcgaccgtccgtagggtccgacgcccgaacggcctccgcccccgtcggtcccg

SEQ ID NO: 432454 - DNA, 580 bp, Homo sapiens
  misc_feature: GZ8MTXP02IEN75.19.85.H08.1.454.CMB.2.raw
  modified_base (383)..(383): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaaccgagggacgccgcttggctgcagcaacgccaggccacccctacccaaactcctgtcgtacaggaatgaaccaaccggccctacaaaacatttccaagagtatacttttaccacctcagacaacaaaatcacgtcctctntacgaccatttacctagtctacccacgcctacgacgacgacggtctacggaacctactactacgtctcacgtccgtagggaccaccacgcctcgctcgtcgttcggtcgttttacggcgggtacgggaccaagtccgtacgtacccgtccgtcggtaccgaacgacccgaaggccctccgcccccgtcggtcctccg

SEQ ID NO: 432455 - DNA, 509 bp, Homo sapiens
  misc_feature: GZ8MTXP02JAA5V.19.85.H08.1.454.CMB.2.raw
  modified_base (288)..(288): a, c, t, g, unknown or other
  modified_base (365)..(365): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggacaccaacaatgtcgcgacaggagccgcttggctgcagcaacgccagggccaccctcccaaactccngtcgtacaggaatgacaaccggccctcaaacatttacagagagactttctacctcagacaacaaatcagcctctctnacccattactgtctccacgctgacgacgacggctgactactactgctcacgcctgggacaccacgcctcgctgcttggctttcggcggaggaccacgctcgaccgtcgtggtcaacgcccgaaggcctcgccccgtcgtctacc

SEQ ID NO: 432456 - DNA, 539 bp, Homo sapiens
  misc_feature: GZ8MTXP02GPXAH.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactcctgtcgtacaggaatgacaaccggccctacaaacattacagagagtactttcacctcagacaacaaatcagcctctctcgaccattactcgtctccagcctgacgacgaggctacgactactactgctcgagtccgtgggacaccacgcctcgctgtcttggtctttcgggcggtacggaccaacggcgtacgaccgtccgtcgggtcaacggccccgaaggccgtccgcccccgtcggtccacccg

SEQ ID NO: 432457 - DNA, 535 bp, Homo sapiens
  misc_feature: GZ8MTXP02ION2M.19.85.H08.1.454.CMB.2.raw
  modified_base (326)..(326): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctacaaacntttaccagagagtactttcacctcaggacaacaaaatcagcctctctgacattactgtctccagcctgacgacgaggctagactactactgctcacgctgggaccaccgagcctcgcgtgtcgttggcgttttcggcggacgggtaccaaacgcgtcgacccgtccgtggtccgaacgcccaaggcctcgcccccgtcggtcctacccg

SEQ ID NO: 432458 - DNA, 568 bp, Homo sapiens
  misc_feature: GZ8MTXP02HZCZ9.19.85.H08.1.454.CMB.2.raw
  modified_base (229)..(229): a, c, t, g, unknown or other
  modified_base (242)..(242): a, c, t, g, unknown or other
  modified_base (311)..(311): a, c, t, g, unknown or other
  modified_base (316)..(316): a, c, t, g, unknown or other
tcagtactctcgtgcacgaccggtgctcgatttagtatcactcagtcgcgggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcacggaacacaacangtcgcacagggancgctggctgcagcaacgccaggccaccctcccaaactcctgtcgtacaggaatgaacaaccggccctanaaacnttacagagagtactttcacctcaagacaacaaaatcacgcctctactagacccattactcgtcctaccacgcctagaccgacgacggctagacctactaactgactcgacgccgtagggacaccgagtccctcggtcctgtcgttggtccgtttacgggcgggaacgggacccaaagccgttacggacccgtccgttcggggaccaacggacccccgtaagggccctccggcccccgttcggtccctacccg

SEQ ID NO: 432459 - DNA, 543 bp, Homo sapiens
  misc_feature: GZ8MTXP02GNAHL.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccacccctcccaaactcctgtcgtacaggaatgaccaacccggccctacaaacattcagagacgtatttcacctcaggaccaacaatacacgcctctctagacctattactgtcctccagcctgacgacgaggctgactactactgctcagcctagggacaccgacgcctcgctgcgttggtccgtttcgggcggtacgggaccaaggccgtcgacccgtccgtcgggtccgacgcccgaacggcctccggcccccgtcggtacccg

SEQ ID NO: 432460 - DNA, 593 bp, Homo sapiens
  misc_feature: GZ8MTXP02J3N8V.19.85.H08.1.454.CMB.2.raw
  modified_base (282)..(282): a, c, t, g, unknown or other
  modified_base (287)..(287): a, c, t, g, unknown or other
  modified_base (470)..(470): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagtcttggttcagcctggaggtccctgagagtctcctgcacagcctctggacttcaccttcagtaactntgagntggactggactcccgccgaggcctaccgaaggaacgggctggagtggattgcctatcgtcaccgtagtgagggctaagtccgacgttccgtacggccggtacttcgtcggtcggccgggggttacccgtttaccacgtcctaccgagacgacagtcgaccaaagaacgtacgtcttcgtttcncgactagttcggaccggtctagagtagacgaacgacgacgtacttatttactacgtgtcggtagaggagggacgggggcctaggtcggtcgtcgggtcggttacgtagtttcgtttgttacgg

SEQ ID NO: 432461 - DNA, 514 bp, Homo sapiens
  misc_feature: GZ8MTXP02JRAJC.19.85.H08.1.454.CMB.2.raw
  modified_base (335)..(335): a, c, t, g, unknown or other
  modified_base (416)..(416): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtcccgggggcctgggacaggccgccacagtcacctgcaccgggaacaccaacaatgtcggcgaccagggagccgcttggctgcagcaacgccagggccacccctccaaactcctgtcgtacaggaatgacaaccggccctcaaacatttcaganacgatttcactccaggacacaatacagcctactctacgaccattactggtcctccagcctgacgacgagctgactactacngctcagcctgggacaccacgcctcgctgctgctttcggcggacggaccgaagcgtcgacccgtctgggtcacgcccgacgctccgccccgtcggtccc

SEQ ID NO: 432462 - DNA, 514 bp, Homo sapiens
  misc_feature: GZ8MTXP02GLAV9.19.85.H08.1.454.CMB.2.raw
  modified_base (456)..(456): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggaatgacaacccggccctacaaacatttcagagacgatttcacctccaggacacaatacagcctctctgaccattactgtctccagcctgacgacgagctgactactactgctcagcctgggacaccgacgcctcgctgcttggtcttttgggnggtacgggacaagcgtcgaccgtcgtggtcgacgccgaacggctacgcccctcggtcc

SEQ ID NO: 432463 - DNA, 509 bp, Homo sapiens
  misc_feature: GZ8MTXP02JDP2B.19.85.H08.1.454.CMB.2.raw
  modified_base (291)..(291): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggacaccaacaatgtcgcgaccagggagccgcttggctgcagcaacgccagggccaccctcccaaactccngtcgtacaggaatgacaaccggccctcaaacatttcagagagatttcacctcaggacacaaaatcagcctctctgaccattactgtctccagctgacgacgaggctgactactactgctcacgtcctagggacaccagcctcgctgcttggctttcggcggtaggaccaagctcgaccgtcctgggtcaagcccaaggcctcgcccctcggtctaccg

SEQ ID NO: 432464 - DNA, 349 bp, Homo sapiens
  misc_feature: GZ8MTXP02IAFJM.19.85.H08.1.454.CMB.2.raw
  modified_base (272)..(272): a, c, t, g, unknown or other
  modified_base (338)..(338): a, c, t, g, unknown or other
  modified_base (345)..(349): a, c, t, g, unknown or other
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagagagggggcactggctggtcgggtcgatcttttgatttgtggggccaaggatcaagcgtctccgtctcttcagcctccacaaggcccatcggtctcccctggccaccctctcaagagcacctcnggggcacagcgccctggctgcctggtcaaggctactcccagagagtactgagcggctggcaaggcnccatagnnnnn

SEQ ID NO: 432465 - DNA, 557 bp, Homo sapiens
  misc_feature: GZ8MTXP02HFMAT.19.85.H08.1.454.CMB.2.raw
  modified_base (226)..(226): a, c, t, g, unknown or other
  modified_base (235)..(235): a, c, t, g, unknown or other
  modified_base (239)..(239): a, c, t, g, unknown or other
  modified_base (242)..(242): a, c, t, g, unknown or other
  modified_base (246)..(246): a, c, t, g, unknown or other
  modified_base (249)..(249): a, c, t, g, unknown or other
  modified_base (299)..(299): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcacggacacaanatgcgcacnggancgntgcngcngcacgcaggccacctccaactcctgtctacagatgacaccgcctacaacnttacagagtagtactttacacctcagtacaaacaaaatcacgcctctactacgacctattactcgtcctccacgtcctaggaccgaacgacggactacgacctactactcgtacctcgaacggtccgacgggaccaacccgacgccctcgctcgtcttcggtcgtttcgggacggacggtaccaacggtccgtacggaccgtccgttcgggacgaacggacccgaacggcctcccggtcccccgtacggtcctacccg

SEQ ID NO: 432466 - DNA, 528 bp, Homo sapiens
  misc_feature: GZ8MTXP02H7HQQ.19.85.H08.1.454.CMB.2.raw
  modified_base (248)..(248): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggacaccaacaatgcggcgaccagganccgctggctgcagcaacgccagggcccacccctcccaaactcctgtcgtacaggaatgaccaaccggccctacaaacatttcaagagacgatttccacctccaggacaacaatcagcctctctgacctattactgtctccagcctgacgacgaggctgactactactgctcagcctgggacaccgagcctcgctgcttggtccgtttcggcggtacgggaccaagcgtcgacccgtcgtcgggtcgacgacccgaacggcctccggcccccgtcggtccc

SEQ ID NO: 432467 - DNA, 528 bp, Homo sapiens
  misc_feature: GZ8MTXP02HUJ0A.19.85.H08.1.454.CMB.2.raw
  modified_base (358)..(358): a, c, t, g, unknown or other
  modified_base (525)..(525): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccggacacacaatgtcgcgacaggagccgcttggctgcagcaacgcaggccaccctccaaactcctgtcgtacaggaatgacaaccggccctacaaacatttcagagagtactttctacctcagtacaacaaatcagcctcnctgaccattactgtctccagcctgacgacgacggctagactactactgctcagcctagggacaccacgcctcgctcgcttggtcgtttcggcggtacgggtaccaaagccgtacgacccgtcgtcgggtccaacggcccgaaacggcctcggccccctcggttcccnccg

SEQ ID NO: 432468 - DNA, 506 bp, Homo sapiens
  misc_feature: GZ8MTXP02FU15E.19.85.H08.1.454.CMB.2.raw
  modified_base (365)..(365): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacctcggtgtccggggcctgggacaggccgccacagtcacctgcaccgggaacaccaacaatgtcggcgaccagggagccgctggctgcagcaacgccagggccacctcccaaactcctgtcgtacaggaatgaccaaccggccctcaaacatttcagagagatttcacctccaggaccacaatcagcctactntgacccattactggtctccagcctgacgacgaggctgactactactgctcagcctgggacaccagccctcgctgcttggcttttcggcggagggacccaagctcgaccgtcctgggtcagccacggctcgcccctcggtcc

SEQ ID NO: 432469 - DNA, 639 bp, Homo sapiens
  misc_feature: GZ8MTXP02IR3OF.19.85.H08.1.454.CMB.2.raw
  modified_base (323)..(323): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacccgtcggtgtccgggggcctgggacacggccgccacagtcacctgcaccgggaacaccaacaatgtcggcgaccagggagcccgcttggctgcagcaacgccagggcccacccctccaaactcctgtcgtacaggatgacaccggccctnaacatttcagagagtactttctacctccaggacacaatacagcctctctagaccactttacgtggtaccgtccacggcccttacgaacggtacccgggagggtacctctaaccgtacttaaacccttcggtcctacccgttacggacccgcgggtaacccggaccaccggacctttccgggcccttggtaccgtttggggtcccggtttttcggggcgggggtaaaccgggacggtaaaaccgcggtccgtaccgtcccgggtcgggttcgacccggaccggtaacccgcggtcccgtccccgtccggttaccccg

SEQ ID NO: 432470 - DNA, 544 bp, Homo sapiens
  misc_feature: GZ8MTXP02FHJT8.19.85.H08.1.454.CMB.2.raw
  modified_base (422)..(422): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgcggcgaccagggagccgcttggctgcagcaacgccagggccaccctccaaactcctgtcgtacaggaatcgaccaaaccggccctacaaacatttcagagagtactttcacctcaggacaacaaaatacacgcctactctagacctattactcgtctccacgcctgacgacgaggctagactactacngctcacgccgtcgggacaccacgcctcgctcgcgttcgtcgtttcgggcggtacgggaccaacgcgtacgacccgtcgtcggtcaacgacccgaacggcctccgccccgtcggtcctacccg

SEQ ID NO: 432471 - DNA, 701 bp, Homo sapiens
  misc_feature: GZ8MTXP02GX8YV.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacctcggtgtccggggcctgggacaggccgccacagtcacctgcaccggaacaccaacatcgtcggcgaccgagggacgccgcttggctgcagcaacgccacggccccaccctacccaaactccctgtaccgtacgaggaactcgaaccgaacccggccccttacaaactactttacagaagtacgtactttttccacctaccaacggtacaaacgaaaactaccacgtacccttacgtacctacgtaaccctattaccgtcgtaccttacccgacgtcccgtacggaaccgacggacggctacggtaaccttaccgtaacttcggaccttaccgacggtacccgtaggggaacccaaccgaccgtcccgttccgacgttcggtccgtttcggggtcccgttttacggggccggggaacggtacccgtaaacggccgttaccgggtaaccccgttcccggtggggtacccaaccgggaccccgaacgggtccccgtaccggtaccccccgttacgggtcccttaacccccg

SEQ ID NO: 432472 - DNA, 642 bp, Homo sapiens
  misc_feature: GZ8MTXP02J3UCP.19.85.H08.1.454.CMB.2.raw
  modified_base (231)..(231): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtcggtccgggggcctgggacaggccgccacagtcacctgcaccggaacaccanaatggtcggcgacgagggacgccgcttggctggcagcaacgccacggtcccacccctacccaaactccctaggtcgtacaaggaactcggaaccacccggccctacaaactatttaccgaagagtacgtacttttaccctaccctaccgaaaggaaccaaaccgtaaaaaattccgaaacgtacccctttctacttacgaaccctaatttaacccgtcgttacctaccacgcccgtacggacgacggacggtctacgtaaccttactactcgtcctcgacgccgtacgggaccaccgacgccgtcgctcggtcttggtccgttttcggcggacgggaccaacgtccgtcgtaccgtccgtcgggtaccgaacggcccgaacggccgtccgtcccccgtcggtccttacccg

SEQ ID NO: 432473 - DNA, 530 bp, Homo sapiens
  misc_feature: GZ8MTXP02JIMCM.19.85.H08.1.454.CMB.2.raw
  modified_base (418)..(418): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccaccctcggtgtccgggggcctgggacaggccgcacagtcacctgcacggaacaccaacatgcggcgacagggagccgcttggctgcagcaacgccagggccacccctcccaaactcctgtccgtacaggatgaaccaacccggccctacaaacatttcagagacgtatttcacctcaggacaacaatacagcctctctgacctattactgtactccacgctgacgcgagcacgactactacgtacnctcacgccgtagggaccacgcgcctcgctcgcgttcggtcgtttcgggacggtacggaccagcgtacgaccgtcgtcggcgacgacccgacggccgccgcccgtcggtcccg

SEQ ID NO: 432474 - DNA, 537 bp, Homo sapiens
  misc_feature: GZ8MTXP02FJRB3.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcgggtgtccgggggcctggggacaggccgccacagtcacctgcaccgggaacaccaacaatgtcggcgaccagggagccgcttggctgcagcaacgccagggccaccctcccaaactcctgtcgtacaggaatgacaaccggccctacaaactattcagagagtatttcactcagacacaaatcagcctctctagacctattactgtctccagcctgacgacgagctgactactactgctcacgccgtacgggaccacccgacgcctcgctgtcgttcggtcgtttcgggacggacgggaccaaggccgtcgaccgtccgtcgggtccgacgacccgacggctccgcccccgtcggtaccc

SEQ ID NO: 432475 - DNA, 559 bp, Homo sapiens
  misc_feature: GZ8MTXP02F4X2F.19.85.H08.1.454.CMB.2.raw
  modified_base (224)..(224): a, c, t, g, unknown or other
  modified_base (237)..(237): a, c, t, g, unknown or other
  modified_base (276)..(276): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcactgcacggacacanatgcgcacaggancgctgctgcagcaacgccaggccaccctcccaaactccngtcgtacaggaatcgacaaccggccctacaaactattacagagagtactttcacctcaggtacaacaaatcaagcctactctagaccattactagtctaccacgcctagacgacgacggctcgactactactagctccagtcctacgggaccacccacgccctcgcctcgtcgttcggtcgtttcgggacggtacgggaccaacggtccgtcggtaacccgtccgtacgggtccaacggaccccgaacgggtccctccgtacccccgtcgggtccttaacccg

SEQ ID NO: 432476 - DNA, 533 bp, Homo sapiens
  misc_feature: GZ8MTXP02G15DG.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccaggagccgcttggctgcagcaacgccagggccaccctccaaactcctgtcgtacaggaatgacaccggcctacaaacattcagagagtatttctactcaggacacaatacagcctctctgacctattactgtcctcacgcctgacgacgaggctgactactactgctcagcgtacgggacaccacgcctcgctgcgttggtcgtttcggcggtacggacccgaagtccgtcgaccgtccgtcgggtaacgacggacccgaacggccgtccggtcccccgtcggtcccg

SEQ ID NO: 432477 - DNA, 526 bp, Homo sapiens
  misc_feature: GZ8MTXP02GSD3F.19.85.H08.1.454.CMB.2.raw
  modified_base (491)..(491): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccaggggagccgcttggctgcagcaacgccacggccaccctcccaaactcctgtcgtacaggaatgacaaccggccctacaaacattcagagagtactttcacctcagacacaaaatcacgcctctctacgacctattactgtctccagcctgacgacgaggctagactactactgctacacgccgtgggaccaccacgcctcgctgcttggtcgtttcggcggacggcaacgtcgtacgaccgttcgnggtcaagcccgacggccgtcgcccctcggtctccg

SEQ ID NO: 432478 - DNA, 527 bp, Homo sapiens
  misc_feature: GZ8MTXP02IZ7VV.19.85.H08.1.454.CMB.2.raw
  modified_base (251)..(251): a, c, t, g, unknown or other
  modified_base (327)..(327): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctggggacaggccgccacagtcacctgcaccgggaacaccaacaatgtcggcgaccaggganccgcttggctgcagcaacgccagggccacccctcccaaactcctgtcgtacaggaatgacaaccggccctcaaacntttcagagagactttcacctcaaggacacaaaatcaagcctctctgaccattactgtctccagctgacgacgacgctgactacgtactgctcacgcctagggacaccgacgcctcgctgcttggctttcggcggtacggaccagctacgaccgtccgtgggtacaacgcccgaaggcctcgcccccgtcggtcctacccg

SEQ ID NO: 432479 - DNA, 532 bp, Homo sapiens
  misc_feature: GZ8MTXP02JXJ1N.19.85.H08.1.454.CMB.2.raw
  modified_base (321)..(321): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacctcggtgtccgggggcctgggacaggccgccacagtcacctgcaccgggaacaccaacaatgtcggcgaccaggggagccgcttggctgcagcaacgccagggccaccctcccaaactcctgtcgtacaggaatgacaaccggccctanaaacatttcagagagactttcacctcaggtacacaaaatcagcctctctgaccattactgtctccagcctgacgacgaggctgactactactgctcacgcctagggaccaccagccctcgctgcttggtcgtttcgggcggtacgggaccaagccgtcgaccgtccgtcggtcaacgcccgaacggtcctccgcccccgtcggtcctcccg

SEQ ID NO: 432480 - DNA, 504 bp, Homo sapiens
  misc_feature: GZ8MTXP02JLJE7.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccacccctcccaaactcctgtcgtacaggaatgacaacccggccctcaaacatttcagagacgatttcacctcaggacacaatacagcctctctgaccattactgtctcagcctgacacgaggctgactactactgctcagcctgggacaccgagcctcgctgctgctttcggcgtaggaccaagctcgaccgtcgtcggcgacgaccacggcctcgcccctcggtcc

SEQ ID NO: 432481 - DNA, 535 bp, Homo sapiens
  misc_feature: GZ8MTXP02IPT24.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttcctgtcgctattttagcaggtgtccaatgtgaggtggagttggtggagtctgggggagcttggttcagcctggagggtccctgagagtctcctgcacagcctctggattcaccttcagtaactatgagatggactggatccgcaggctccgaggaagggctggagtggattgcctatgtcactagtgagggcgaagtcacgtcctacgcggactcgtgtggccggggtccgttacatcctcagagacaatcgaccaagaagacgcttacttctgactaagttcggacggccctgagacggtacgaaagacacggctaatttactactgtgtgaggtaggacggggcacgtggcgtgggtcggtgacgtttcgtttagtag

SEQ ID NO: 432482 - DNA, 570 bp, Homo sapiens
  misc_feature: GZ8MTXP02IYJY3.19.85.H08.1.454.CMB.2.raw
  modified_base (424)..(424): a, c, t, g, unknown or other
  modified_base (523)..(523): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccaggggagccgcttggctgcagcaacgccacgggccacccctccccaaactcctgtcgtacaggaatgaaccaaccggccctacaaaccatttacaagtagacgtactttttccacctccaaggacaacaaaactcacgcctactctacgacctattactcgtctccacgcctgacgacgngctcgactactactgctacacgccgtacgggaccaaccgcgcctcgcgtcgtcgtttcggtcgtttcggcggacggacctaacgcgtacgaccgtccgngggtaccaacgcccgaacggtcctccggcccccgtcgtaccgtaccc

SEQ ID NO: 432483 - DNA, 617 bp, Homo sapiens
  misc_feature: GZ8MTXP02GZN4I.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacacggccgccacagtcacctgcaccggaacaccaacaatgtcggcgaccgagggacgccgcttggctgcagcaacgccaggccaccctccaaactcctgtcgtacaggaatgaccaaccggcctacaaacattcagagacgtactttcacctcagacaacaactacacgtcctactactacgacctattactgtcctaccacgtccctagacgacgacggctacgactactactcgtacctcgacgtccgtacgggaccaaccgacgtcccgtcgtcgtcgtcgttcggttccgttttacggggaccggggtaacggtaacccgaaacggtccgtacgggtaccccggttaccgttcggggtaacccgacggtaccccgaaacggggtcccttacccggtccccccgtcgggttacccccg

SEQ ID NO: 432484 - DNA, 563 bp, Homo sapiens
  misc_feature: GZ8MTXP02GOBW2.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctgggagggtccctgagagtctcctgcacagcctctggattcaccttcagtaactatgagatggactggatccgccaggctcgaggaagggctggagtggattgcctatgtcactagtgaggcaagtcacgtcctacgcggactcgtgtcggccgggggtccgtttaccatcctcagagaacatcgaccaaagaagaccgcttactttctgactaagttgggacggcctaggacgagtacggaagacgacgggtacttagtttaacttacttggtagtaggaggagggagggggcacgtgggcgtcgggtcgggtcgtacgttcgttttagttagg

SEQ ID NO: 432485 - DNA, 560 bp, Homo sapiens
  misc_feature: GZ8MTXP02I81GG.19.85.H08.1.454.CMB.2.raw
  modified_base (333)..(333): a, c, t, g, unknown or other
  modified_base (363)..(363): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggaacaccaacaatgtcggcgaccagggagccgcttggctgcagcaacgccagggccaccctcccaaactcctgtcgtacaggaatcgacaacccggcctcaaacattcaganacgtatttcactcagacacaatcagcctcnctgaccattactgtctcagctgacgacgagctagactactactgctcacgccgtcgggaccaccgacgccgtcgctcgtccgttcggtcgtttttcgggtcgggtacgggtacccgtaaacggtcctacggtaacccggttccgtcgggtccgacggtcccgaaacggtcctcccggtcccccgttcgggtaccccg

SEQ ID NO: 432486 - DNA, 558 bp, Homo sapiens
  misc_feature: GZ8MTXP02JVVRN.19.85.H08.1.454.CMB.2.raw
  modified_base (446)..(446): a, c, t, g, unknown or other
  modified_base (448)..(448): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctgggagggtccctgagagtctcctgcacagcctctggattcaccttcagtaactatgagatggactggatccgcgaggctccaaggaaaggggctagggagtggattgctatgtcacctagtgaggcgagtcacgtccacgcgtactcgtgtcggccggggtccgtttaccagttcctaccgagacgaacaatcgaccaaagaacgacgcttacttcngntaagtggaccggactgagagtcgaagacgacggactatttacttagtgtgtaggaggacgggagggggacaggtggtcgtcggggtcggtcgtagtttcgtttagttagg

SEQ ID NO: 432487 - DNA, 581 bp, Homo sapiens
  misc_feature: GZ8MTXP02HB9Q0.19.85.H08.1.454.CMB.2.raw
  modified_base (321)..(321): a, c, t, g, unknown or other
  modified_base (329)..(329): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccggaacaccaacaatgtcgcgacgaggagccgctggctgcagcaacgccaggccacctcccaaactcctgtcgtacaggaatcgaacaaccggccctacaaacnttacaganagactttcacctcagacaacaaaatcacgcctctactacgaccatttactgtacctccagcctgaccgacgacggctacgactactacgtagcctcacgccgtacggaccacccacgacccgtcgactcggtcctttcggtccgttttcgggaccggtacgggacccgaaacgtccgtacggacccgtccgtacgggtaccgaaccggacccgaacggtccgtacccgcccccgtccgggttacctaccccg

SEQ ID NO: 432488 - DNA, 521 bp, Homo sapiens
  misc_feature: GZ8MTXP02I1ILE.19.85.H08.1.454.CMB.2.raw
  modified_base (294)..(294): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccacccctcccaaactccngtcgtacaggaatgacaaccggccctacaaacattcagagagactttcacctcaagacaacaaaaatcagcctctctgaccattactgtctcagctgacgacgaggctgactactactgctcacgcctgggacaccacgcctcgctcgcttgctttcggcggtagggaccaagctcgaccgtccgtagggtcaagacccgaaggcctcgcccccgtcggtactaccg

SEQ ID NO: 432489 - DNA, 502 bp, Homo sapiens
  misc_feature: GZ8MTXP02JZT77.19.85.H08.1.454.CMB.2.raw
  modified_base (360)..(360): a, c, t, g, unknown or other
  modified_base (373)..(373): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccaggagccgcttggctgcagcaacgccaggccacctcccaaactcctgtcgtacaggaatgacaaccggccctcaaacatttcagagagactttcacctcagacacaaatcagcctntctgaccattacngtctcagctgacgacgaggctgactactactgctcagcctgggacaccagcctcgctgcttggctttcggcgtaggcaacgctcgaccgtcctaagtcaacgcccgaacgctcgcccctcggtctaccg

SEQ ID NO: 432490 - DNA, 529 bp, Homo sapiens
  misc_feature: GZ8MTXP02GNXQA.19.85.H08.1.454.CMB.2.raw
  modified_base (515)..(515): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactcctgtcgtacaggaatgacaaccggccctacaaacatttcagagacgtatttcacctccaggacaacaaatacaagcctctctagacctattactgtcctcagcctgacgacgaggctgactactactgctcagccgtagggaccaccacgcctcgctgtcgttcggtcgtttcggcggtacgggaccaagctcgaccgtcgtcgggtcacggccgacggccncgtcccctcggtcc

SEQ ID NO: 432491 - DNA, 514 bp, Homo sapiens
  misc_feature: GZ8MTXP02J1WFW.19.85.H08.1.454.CMB.2.raw
  modified_base (249)..(249): a, c, t, g, unknown or other
  modified_base (290)..(290): a, c, t, g, unknown or other
  modified_base (316)..(316): a, c, t, g, unknown or other
  modified_base (321)..(321): a, c, t, g, unknown or other
  modified_base (360)..(360): a, c, t, g, unknown or other
  modified_base (374)..(374): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggacaccaacaatgtcggcgaccaggganccgcttggctgcagcaacgccaggccacctcccaaactccngtcgtacaggaatgacaccggccctnaaacnttcagagagactttcacctcaggacacaaaatcagcctnctgaccctattacncgtctcccagctgacgacgagctgactactactgctcacgctagggacaccagcctcgctcgcttcgctttcggcggagggaccaaggccttcgaccgtcgtgggtccaagcccgaaggcctcgcccctcggtctacccg

SEQ ID NO: 432492 - DNA, 567 bp, Homo sapiens
  misc_feature: GZ8MTXP02GKER6.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccaggccacccctcccaaactcctgtcgtacaggaatgacaacccggccctacaaacatttcagagagactttcacctcagacacaaaatcagcctactctgaccattactgtctccagcctgacgacgaggctagactactactgctcagcctgggaccaccacgccctcgctcggtcttcgggtcttttcgggccgggtacggggtacccaaacggtccgtacggtaccccggttccgtcggggttccgaacggtccccgaacgggccctaccggccccccttcgggtcctacccg

SEQ ID NO: 432493 - DNA, 576 bp, Homo sapiens
  misc_feature: GZ8MTXP02GXADL.19.85.H08.1.454.CMB.2.raw
  modified_base (228)..(228): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccggaacacaanatgtcgcgacaaggagccgcttggctgcagcaacgccagtacccaccctcccaaactcctgtcgtacaggaatcgaacaaccggccctacaaactatttacagagtagtaacttttccacctacaaggtacaacaaaaataccacgcctactactagaaccatttacctgtcctaccacgcctagacgacgacggctcgactactactcgcctcacgccgtgggaacacccacgcctcgctcgtcgttcggtcttttcgggcggacgggaccaacggtcgtacggtacccgtccgtcgggtaccgaacgccccgaaacggcctaccggcccccgtcggtacctacccg

SEQ ID NO: 432494 - DNA, 530 bp, Homo sapiens
  misc_feature: GZ8MTXP02IWL0B.19.85.H08.1.454.CMB.2.raw
  modified_base (399)..(399): a, c, t, g, unknown or other
  modified_base (404)..(404): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctggagggtccctgagagtctcctgcacagcctctggattcaccttcagtaactatgagatggactggatccgcaggctccgaggaagggctggagtggattgcctatgtcactagtgaggcgaagtcacgtcctacgcggactctgtcgcggggtccgttacatctcaganacaancgacaagaagacgctcttctgctagttggacggcctgagagtacgaagacacggtctaatttattactgtggtagaggaggacgggggcacgtggcgtcgggtcgggtcgtacgttcgttttgtag

SEQ ID NO: 432495 - DNA, 728 bp, Homo sapiens
  misc_feature: GZ8MTXP02G54M5.19.85.H08.1.454.CMB.2.raw
  modified_base (352)..(352): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacgacgtcaccgtgacgaccggaacacaacaagtcggcggcgacgagggacgccgcgttggctgcagcaaccggccgacggtaccccaccctaccccaaactccgtcgtaccgtacaggaactcgaaccaacccggccctaacaaactnttacaagagattacctttaccacctacgaacgtaacaaacaaaatccgactacctcctacctacgtaacctaactttaccgtacgttacctacccgtaacgtcccgttacggaacccgtaacggaccggttccgtaacggtaaaccctaaccttaccgttcggacccttacgaaccgtccggtacggggaacccaaccctaccgggcccctacggtccgttcgttcccgtttacggggttccctttacgggggacccgggtaacggggaccctaaaggtccccggttaacgtccccgggttacgtaccggggaccgaaccgtccccggaaacgggtcccgtacccggtccccccgttcggtacccttaacccccgg

SEQ ID NO: 432496 - DNA, 547 bp, Homo sapiens
  misc_feature: GZ8MTXP02JZW22.19.85.H08.1.454.CMB.2.raw
  modified_base (364)..(364): a, c, t, g, unknown or other
  modified_base (388)..(388): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagcccaccctcggtgtccgggggcctgggacaggccgccacagtcacctgcaccgggaacaccaacaatgtcggcgaccgagggagccgcttggctgcagcaacgccgaggcccaccctcccaaactcctgtcgtacaggaatcgacaaccggccctacaaacattacagagatactttcactcagacaacaaatcanctctctcactattactgtctccancctagacgacgagctgactactactgctcgacgcctgggaccaccgacgcccgtcgctcggtcgttcggtcgtttcgggcggtacgggaccaacggtccgtacgcccgtcgtcggtaccgaacgccccgaaggccgtccgcccccgtcggtcctacccg

SEQ ID NO: 432497 - DNA, 598 bp, Homo sapiens
  misc_feature: GZ8MTXP02F1PDB.19.85.H08.1.454.CMB.2.raw
  modified_base (255)..(255): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcgggtgtccgggggcctgggacaggccgcacagtcacctgcaccggaacaccaacaatggtcgcgaccagggacgccgntggctgcagcaacgccgacggcccacccctcccgaactccgtgtacgtacaggactcgaccgaacccgccctacaaactattcaagtagacgtacttttccacctcgagtaaccaacaacgtcacgccttctactacgacctattacgtcgttcctaccacgtccctagaccgacgacgctgacctactacgtgcctacacgccgtacgggaccaccgaccgtcctcgtcgtcgtcgttcggttccgtttacgggacggtacggtaccgacgtcgtaccggtaccggttccgtacgggtaacccgacggacccgacggtccgtcccggccccgtcgtaccccg

SEQ ID NO: 432498 - DNA, 576 bp, Homo sapiens
  misc_feature: GZ8MTXP02IRXOC.19.85.H08.1.454.CMB.2.raw
  modified_base (323)..(323): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgctggctgcagcaacgccaggccacccctcccaaactcctgtcgtacaggaatgaccaacccggccctanaaacctattcaagagtacgtacttttcacctccaaggtaccaacaatacaacgccctactacacgaacctattaactcgtctccacgtcctagacgacgacggctacgactactactgctacgacgtccgtacgggacctaccgacgcctcgcgtcggtcgttcggtcgttttcgggacggtacgggaccgtaaacggcgtcgacccgtccgtggtaaccgacgcccgacgccgtccgccccgtacggtcccg

SEQ ID NO: 432499 - DNA, 584 bp, Homo sapiens
  misc_feature: GZ8MTXP02IC82R.19.85.H08.1.454.CMB.2.raw
  modified_base (435)..(435): a, c, t, g, unknown or other
tcagtactctcgtgcacgaccggtgctcgatttagtatcactcagtcgcggggtccaaacagagcttcagcaagcatagtgggaatctgcaccatgcccctgggctctgctcctcctgaccctcctcactcactctgcagtgtcagtggtccaggcaggactgactcagccaccctcggtgtccgggggcctgggacaggccgcacagtcacctgcaccgggaacaccaacaatgtcggcgaccgaggggacgccgcttggctgcagcaacgccaggcccaccctccccaaactccctgtcgtacaggatgaccaaccggccctacaaactatttaccagagagtacttttccacctcagaacaacaaatcagcctctactagaccctatttacctgtcctaccacgtcctcgacgacgaggctagactactacncgtctcgacgtccgtagggaccaccgacgccctcgcctgtcttcggtcgttttcgggcggtacggaccaacgtccgtacggtacccgtccggtacggtccgaacggcccgaaacggtcccgtcccggtccccccgtcggtacctccccg

SEQ ID NO: 432500 - DNA, 542 bp, Homo sapiens
  misc_feature: GZ8MTXP02IGTEB.19.85.H08.1.454.CMB.2.raw
  modified_base (226)..(226): a, c, t, g, unknown or other
  modified_base (241)..(241): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcacgggacacanatgtcgcaccagganccgcttggctgcagcaacgccagggccacccctccccaaactcctgtcgtacaggaactgaccaaccggccctcaaacatttcagagagtacttttcacctccaggacaacaaaatcagcctctctgaccattactgtctccagcctgacgacgagctacgactactactgcctcacgcctgggacaccagcctcgctgtcttggctttcgggacggacgggtaccaacgtccgtacgtacccgtccgtcggggtacaacggcccgaacggtcccgtaccggccccctcgggtcctacccg

SEQ ID NO: 432501 - DNA, 536 bp, Homo sapiens
  misc_feature: GZ8MTXP02IGB8N.19.85.H08.1.454.CMB.2.raw
  modified_base (249)..(249): a, c, t, g, unknown or other
  modified_base (258)..(258): a, c, t, g, unknown or other
  modified_base (260)..(260): a, c, t, g, unknown or other
  modified_base (262)..(262): a, c, t, g, unknown or other
  modified_base (283)..(283): a, c, t, g, unknown or other
  modified_base (285)..(286): a, c, t, g, unknown or other
  modified_base (293)..(294): a, c, t, g, unknown or other
  modified_base (310)..(310): a, c, t, g, unknown or other
  modified_base (312)..(312): a, c, t, g, unknown or other
  modified_base (314)..(314): a, c, t, g, unknown or other
  modified_base (341)..(341): a, c, t, g, unknown or other
  modified_base (366)..(366): a, c, t, g, unknown or other
  modified_base (370)..(370): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctggggacaggccgccacagtcacctgcaccgggaacacaacaatgtcggcaccagggancgcttggcngnanacacgcgacgccaccaccacncnncacagannacacgaccacaacatnananatacttactacctacacgacaacaaanacacactctctcactatactcgtcncacnctacgacgacgacgactacactactactacgtctacacgtaccgtacggacgaccaccgacctcgtcgtcgtcgttcggttcgtttcggtacggacgggaaccgaacgacgtacgtaccgtaccgtacgtacgaacgaccgacgccgccgtcccgtccgtacctcc

SEQ ID NO: 432502 - DNA, 571 bp, Homo sapiens
  misc_feature: GZ8MTXP02HWA7O.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggaacaccaacaatgtcggcgaccaggagccgcttggctgcagcaacgccagggccaccctcccaaactcctgtcgtacaggaatgacaaccggccctacaaacatttcagagagtactttctacctccaaggtacacaaaatcacgtcctctacctgaccattactcgtctccagcctgacgtacgacggctgactactacagctcacgtcctgggacaccagccctcgctgcttcggtcgttttccggcgggtacgggacccgtaaacggtccgtcggtacccgtccgttacgggtccaaccggtacccgaacggtccgtaccggtccccccgttcgggtcccttacccg

SEQ ID NO: 432503 - DNA, 616 bp, Homo sapiens
  misc_feature: GZ8MTXP02FZYGF.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacccgtcggtcggtccgggggcctgggacacggccgccacagtccacctgcaccgggaacaccaacatgtcggacgaccgagggacgcccgcttggctgcagcaaccgccgacgggccccacccctcccaaactcctgtccgtaacaggaatcgaaccaacccgggcccctacaaaacctatttaccgaagacgacgttacttttccaacctccgaggaaccaacaaacgtacaacgcctcgtctcgaacctattactggtcctcacgcctgacgacgagactgactactactcgctacgacgccgtacgggaccacccgacgcctccgtcgtcgtcgttcggttccgttttcgggccgggtaacgggaccgtaaacggcgtacgtaacccgtcggttacgggcgacgacccgaacggcccgtccggcccccgttacggtccccg

SEQ ID NO: 432504 - DNA, 604 bp, Homo sapiens
  misc_feature: GZ8MTXP02H44N6.19.85.H08.1.454.CMB.2.raw
  modified_base (249)..(249): a, c, t, g, unknown or other
  modified_base (382)..(382): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgacaggganccgcttggctgcagcaacgccaggccacccctcccaactccctgtcgtacacggaatgaaccaaccggccctacgaaacatttcagagtagtactttcctaacctccaaggtacaacgaaaatcacgcctacnctagaccattactgtcctcacgtcctagacgacgacggctacgactacgtactagacttcacgtaccgttggggaacccacccgtacgtccctacggtcctcgttccgttcggtccgttttccggggacggtacggggtaacctaaaggtcccgtcggtacccgtccgtggggtaccaacggcccgaaacggtccctccggtcccccgtcggtacctacccg

SEQ ID NO: 432505 - DNA, 517 bp, Homo sapiens
  misc_feature: GZ8MTXP02HNAT4.19.85.H08.1.454.CMB.2.raw
  modified_base (334)..(334): a, c, t, g, unknown or other
  modified_base (361)..(361): a, c, t, g, unknown or other
  modified_base (367)..(367): a, c, t, g, unknown or other
  modified_base (376)..(376): a, c, t, g, unknown or other
  modified_base (384)..(384): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactcctgtcgtacaggaatgacaaccggccctacaaacattcaganagactttcactccagacacaaaatcanctctcnaccattacngtctccanctgacgacgaggctgactactactcgctcacgcctgggaccaccacgccgtcgctcgcttgcgtttcggcggtaggaccaacgtctcgaccgtcgtcggtcaacgcccaaggcctcgcccccgtcggctaccg

SEQ ID NO: 432506 - DNA, 812 bp, Homo sapiens
  misc_feature: GZ8MTXP02HWMYK.19.85.H08.1.454.CMB.2.raw
  modified_base (236)..(236): a, c, t, g, unknown or other
  modified_base (251)..(251): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgccacccgtcggtcggtcccgggggcctgggacacggccgccacagtcacctgcaccggaacacaanatgcgcgacgagganccgctggctgcagcaacgccgacggcccacccctaccaaacctccgtcgtacgtaaccgaggaactacggaaccgaaacccgggtccctaaccaaaactaactttaccgaaaggaacgtaccgttaactttttacctaacccctaccgaaggaaacccaaactaaaacttaccgaacgtacccccttacctacctaacgaaacccttaaactttaacccgtacggttacccttacccgaccggtaccccgttacggaaccggtaaccggaacgggtaccgttaaccggtaaccgttaaaccgttaaacctcgtaccgttaccgtaacgacccgggttaccggggtaacccaacccgtaaccggaccccgttccggtacccgttcggttcccggtttccggggttacccggtttttcccgggggacccgggggttaaaccggggtaacccgaaaacggtcccgtaccggtaaccccggttcccggttacgggttaacccggacccggtaccccggaaacgggtccccgtaccccggtaccccccgttaccgggttacccccg

SEQ ID NO: 432507 - DNA, 684 bp, Homo sapiens
  misc_feature: GZ8MTXP02ILUSV.19.85.H08.1.454.CMB.2.raw
  modified_base (272)..(272): a, c, t, g, unknown or other
  modified_base (276)..(276): a, c, t, g, unknown or other
  modified_base (283)..(283): a, c, t, g, unknown or other
  modified_base (317)..(317): a, c, t, g, unknown or other
  modified_base (444)..(444): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcgggtcggtccgggggccgtggggaccacggcccgccacagtccaccgtgaccgaaccgggaacaccaaacaagtggccggacgaccgagggacnccgngttggcngcagcaacgccacggcccaccctaccgaactccncgtacgtacgagaactcgaaccgaaccgaccctaacgaaactacttacaagtacgtagttaacctttaccaaccctacgaacgaaactaaacaaaactcgactacctactctaacgactacgttacncgtctaccacgtccgtgaaccgagacgtactacgtaactacctacgtcgtaccttacgaacgtccgtaacgggacccaaacccgcgtacccgtcgtccgttcggtcgttcgggttccggtttacgggcgggtaaacgggaccgaacggtccgtacggttacccggtcgttaccgggacctaaccgggacccgtaaacggtcccgtacccggtacccccgttccgggtactttacccccgg

SEQ ID NO: 432508 - DNA, 602 bp, Homo sapiens
  misc_feature: GZ8MTXP02IJSOU.19.85.H08.1.454.CMB.2.raw
  modified_base (232)..(232): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctggggacaggccgccacagtcacctgcaccgggaacaccaanatgtcggcgaccagggacgccgcttggctgcagcaacgccgacgggccacccctaccccaaactcctgtacgtacaggaactcgaaccaacccggcccctacaaacatttacagagagtaccttttacctacctaccgaaggtaccaaacaaaaacttccgacgtaccctaccttcctacgaacctagttacctacgtctcccacgtcctgaccgacgacggctagactactactgcctcgacgtccgtagggaccacccgacgcctccgtctcgcgttcggtcgtttcgggacggacggaccgacgtcgtacggtaccgtccgtcggtacgcgacccgaacggtcgtccgtccccgtacgtcgtacccg

SEQ ID NO: 432509 - DNA, 911 bp, Homo sapiens
  misc_feature: GZ8MTXP02HJ1LI.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgccaaccgggaacaccaacaatggtcggcgaccgagggagccgcttggctgcagcaacgccacggcccaccctcccaaactcctgtcgtacaggaatcgaaccaaccggccctacgaaactactttacaagtagtagtacttttaccgacctaccgaaggacaaacaaaatccacgtacctacctacctacgaaccctaacgtttaaccgtcgggttaccctacccgtacgtaccccgttacggtaaacccggaacgggtaaccggtacccgggttaccggtaaaaccctttaaacccggttaacccgtttaccggggaccccttttaaccccgggaaaacccgggttcccccggggtttaacccgggggtaaaacccctaaaccccccggaaaccgggtaccccccgtttacccggggtacccgtttacccggggttaccccggtttttaccgggggtttaccccgggttttttcccccggggggaacccggggggtttaaaaccccggggggaaacccccgtaaaacccggggttcccgggtttaaccccggggtaaacccccggggtttcccggggtttacccgggggtaacccgaaccccgggggttaaccccccggaaaacgggggttacccccgttacccccgggtcccccccccggtttaaccgggggtttccccctttaaaccccccgg

SEQ ID NO: 432510 - DNA, 522 bp, Homo sapiens
  misc_feature: GZ8MTXP02FJ3C6.19.85.H08.1.454.CMB.2.raw
  modified_base (416)..(416): a, c, t, g, unknown or other
  modified_base (483)..(483): a, c, t, g, unknown or other
tcagtactctcgtgcacgaccggtgctcgatttagtatcactcagtcgcgggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcactgcaccgggaacaccaacaatgtcggcgaccagggagccgcttggctgcagcaacgccagggcccaccctcccaaactcctgtcgtacaggaatgacaaccggccctacaaacatttcagagagacttttctacctcaggacaacaaaatcagcctctctgaccattactggtctccagcctgacgacgaggctgactactacngctcagcctgggaccaccacgcctcgctgcttggtctttcgggcggaggaccaacgctgacccgtcngggtcaacgccctaaggcctcgccccctcggtctacccg

SEQ ID NO: 432511 - DNA, 599 bp, Homo sapiens
  misc_feature: GZ8MTXP02IYIOG.19.85.H08.1.454.CMB.2.raw
  modified_base (444)..(444): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggacacaacatgtcgcgaccgagggacgccgcttggctgcagcaacgccacggcccaccctcccaaactcctgtcgtacgaggaatcgacaacccggccctacaaactatttacagagacgtacttttaccacctcacggacaactaaaaactcaagccctctacctacgacctattacctcggtcttcccacgcctagaccgacgacggctacgacctactacncgctacgacgtccgtacgggacctacccacgtcctcgctacggtcgttcggtccgtttcgggccggtacggggaccaacggcttacggcccgtaccgtcggggtaccaaccggacccgaacggtccgtcccggtcccccgtcggtaccttacccg

SEQ ID NO: 432512 - DNA, 524 bp, Homo sapiens
  misc_feature: GZ8MTXP02HMUPY.19.85.H08.1.454.CMB.2.raw
  modified_base (224)..(224): a, c, t, g, unknown or other
  modified_base (226)..(226): a, c, t, g, unknown or other
  modified_base (230)..(230): a, c, t, g, unknown or other
  modified_base (233)..(233): a, c, t, g, unknown or other
  modified_base (239)..(239): a, c, t, g, unknown or other
  modified_base (347)..(347): a, c, t, g, unknown or other
  modified_base (403)..(403): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacctcggtgtccgggggcctgggacaggccgccacagtcactgcacggacacanangcgnacnggagcntgctgcagcacgcaggccacctcccaactcctgtcgtacaggaatcgacaccggcctacaacattcagacgtagtactttcacctacagacaacaaatcagtcctacnctacgactaattactgtcctaccacgtccgtagacgacgaggctacgactacgtancgctcagcctagggaccacagcctcgctgctgtacgtttcggcggtacggactaacgccgtacggaccgtccgtcgggtccaacgccgaacggtccctacggcccccgtacgtaccgtccg

SEQ ID NO: 432513 - DNA, 597 bp, Homo sapiens
  misc_feature: GZ8MTXP02IX10D.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtccgggggcctgggacaggccgccacagtcacctgcaccgggaacaccaacaatgtcggcgaccagggacgccgcttggctgcagcaacgccaggcccaccctcccaaactcctgtcgtacaggaatcgaacaaccggccctacaaactatttccaagagtagtactttcacctcaggacaacaaaatcagacctctactagaacctattactcgtctccacgcctagacgacgacggctacgactactactgcctcgacgtccgtacgggacctaaccgacgccgtcgctcgtccgttggtcgtttacgggacggtacggtaccgtaaacggtccgttacggaccgttaccggtcgggtacgaaccggtaccccgaacgggtcccgtaccggtcccccgtacgggtccctacccg

SEQ ID NO: 432514 - DNA, 504 bp, Homo sapiens
  misc_feature: GZ8MTXP02JB8D4.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccacccctcccaaactcctgtccgtacaggaatgacaaccggccctcaaacattcagagagatttcactccaggacacaatcagcctctctgaccattactggtctcagcctgacgacgaggctgactactactgctcagcctgggacacagcctcgctgctggctttcggcggtaggcccaagctcgaccgtccgtggtcacgcccaggcctcgccccgtcggtccc

SEQ ID NO: 432515 - DNA, 550 bp, Homo sapiens
  misc_feature: GZ8MTXP02G25Z8.19.85.H08.1.454.CMB.2.raw
  modified_base (402)..(402): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagcttggttcagcctggagggtccctgagagtctcctgcacagcctctggattcaccttcagtaactatgagatggactggatcccgcgaggctaccgaggaaagggctggagtggattgcctatgtcactagtgaggcgaagtcacgtcctacgcgactctgtgcggggtaccgttacatctccaganacaatcgacaagacgacgcttacgttctgataagtcggacgcctagagagtacgaacgtacgacgtgtaatttattacgtgttggtagaggagggacgggggcctaggtcggtcgttcggggtcggttacgagtttcgtttagttagg

SEQ ID NO: 432516 - DNA, 588 bp, Homo sapiens
  misc_feature: GZ8MTXP02JKP3L.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctggaggtccctgagagtctcctgcacagcctctggattccacccttcagtaactatgagatggactggactccgcaggcctccgagggaaaggggctagggagtggattcggccttagtgtacacgtagtggagggcgaagtccacgtccgtacgcgtactcgtggtcggccgggggtcccgtttaccagtcctaccgagagacaagtcgaccaaagaacgacgtcttacttctcgacgtaagttcgggacggtcctgaggagtcgaacgacgacggtacttatttactacgtgtggtagaggtagggacgggggtcacggtcggtcgtcggggtcgggtacgtgtttcgtttagttagg

SEQ ID NO: 432517 - DNA, 772 bp, Homo sapiens
  misc_feature: GZ8MTXP02I4WGB.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgcccacccgtcggtcggtccgggggcctgggaccacgggccgccacagtccacctgccgaccggaacaccaacaatggcggcgaccgagggacgccgcttggctgcagcaacgccgagggcccaccccgtaccaaactcctcgtccgtacaggaatcgaaccaacccggccctacaaactatttcaagagtacgtatttcctacctaccgacggaaccaacaaactccaacgtcccttactacctacgaaccctaagtttaaccgtcggttaccctacccgacgtacccttacggaaaccggaccggtaacggggtccttacggaaccttaaccgttaaccgttccgtccgttaacccgtaccggtaccccggttacgggggaaaccctaaccccgaacggtacccccgttcggtacccgttcggttaccgtttccggggtcccggtttttacccgggggaccgggggtaaaccggggtacccgtaaacgggtcccgtaccggggtaaccccggttcccggtacgggggttaacccgtaaccgggaccccggtaaaccggggtccccgtaccccggtacccccggttcccgggtttacccccg

SEQ ID NO: 432518 - DNA, 574 bp, Homo sapiens
  misc_feature: GZ8MTXP02IMDPH.19.85.H08.1.454.CMB.2.raw
  modified_base (245)..(245): a, c, t, g, unknown or other
  modified_base (402)..(402): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagccgtgggaggtccctgagngtctcctgcacagcctctggattccaccttcagtaactatgagatggactggactccgccaggctccgaggaaaggggctggagtggattgcctatgtcacgtagtgagggcaagtcacgtccgtacgcggactcgtgtcggccggggtccgttacntcctcagacgacatgaccaagaacgcgcttacttctgactaagttcgggaccggtcctggagagtacgaagaccgacggcttaagtttacttaacgttgtacgtggacggtaggggacgggggtcacggtgggcggttcggggtcggtacgtacgtttcgttttagttacgg

SEQ ID NO: 432519 - DNA, 603 bp, Homo sapiens
  misc_feature: GZ8MTXP02HX9RR.19.85.H08.1.454.CMB.2.raw
  modified_base (334)..(334): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctacaaactattcaganagtactttctaccctcaggacaacaaaatcagcctctctgacctattactgtactcagcctgacgacgacggctgactacgtactgacctcacgtccgtagggacacccaacgccctccggctcgtccgttgggtccttttccggggacgggtacggggtacccaaacggtccgttacggaccccggttcccgtcgggggttaccaaccgggtacccccgaaaacggggcccctaccggacccccccgttacggggtcccctaaccccg

SEQ ID NO: 432520 - DNA, 667 bp, Homo sapiens
  misc_feature: GZ8MTXP02F7A2T.19.85.H08.1.454.CMB.2.raw
  modified_base (260)..(260): a, c, t, g, unknown or other
  modified_base (264)..(264): a, c, t, g, unknown or other
  modified_base (269)..(269): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgccacccgtcggtcggtccgggggcctgggacacggccgccacagtcacctgaccgaccgggaacaccaacaatcggcgcgacgagggacnccgntggcngcagccaacgccgacgggcccaccctaccgaaactccgtgtaccgtaacgaggaactcgaaaccaacccgggacctaacgaaactacttcgaaagtacgaacgttactttaccgacgtaccgaaggaaccaaacaaacttaccgactacctacctacgtacgtaaacctactttacgtcggttcccaccgtaacggacccttacgaaacggaccggtaacggtacctacgaaaccttacgtaccgttacgccgttacgacgtaccgtacgggacccaaccgcgtcctcgcgtcgtcgtggtaccgttcgggacggtacggaccgtaggtccgtacgacccggtcgtacgggtccgaaacggcccgtaacggtcccgtaccggccccgtacggttcccc

SEQ ID NO: 432521 - DNA, 556 bp, Homo sapiens
  misc_feature: GZ8MTXP02JECTZ.19.85.H08.1.454.CMB.2.raw
  modified_base (114)..(114): a, c, t, g, unknown or other
  modified_base (283)..(283): a, c, t, g, unknown or other
  modified_base (400)..(400): a, c, t, g, unknown or other
tcagtactctcgtgcacgaccggtgctcgatttagtatcactcagtcgcggggctccaaacagagcttcagcaagcatagtgggaatctgcaccatgccctgggctctgctccncctgaccctcctcactcactctgcagtgtcagtggtccaggcaggactgactcagccaccctcggtgtccggggccgtgggacgaggccgccacagtcacctgcaccggaacaccaacaatgtcggcgaccaggagccgcttggctgcagcacgccacgggccaccccnccccaaactcctcgtcgtacaggaatagacaaacccggacccgtcaaaccaatttacagagagatttctacctccaggacacaataacagacctctctgaccatactgtcgtacccncgcctacgacgacgacgactacgactactactcgctcacgccgtacggacgaccgaccgccgtccgcgtcgtcgttcggttcgtttcggtacgggacggacgacgcgtcgtaccgtccgtcggtcgacgaccgacgaccgtccgtcccgtccgtcg

SEQ ID NO: 432522 - DNA, 621 bp, Homo sapiens
  misc_feature: GZ8MTXP02GW96Z.19.85.H08.1.454.CMB.2.raw
  modified_base (306)..(306): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtccgggggcctgggacaggccgccacacgtcacctgaccaccgggaacaccaacaatcggtcggacgaccgagggacgcccgcgttggctgcagccaacgccacggcccaccctcccaaactccngtaccgtacaggaactcgaaccaaccggccctacaaactcttacagagtactacttttaccacctccgaagtaccaaacaaaactcgacgtcctactctacgaaccctattacgtacgtacctaccgtacgccgttacggaacccggacgtacgggcttacgacctacgttacgtacgccttacgacgtccgtacgggaccaccgacgcctacgcgtcgtcgttcgtcgtttcggacggacgggacacggtcgtacgacccgttcgtggtaccaacggtacccgacggtcctccggccccgtcgtaccgtacccg

SEQ ID NO: 432523 - DNA, 580 bp, Homo sapiens
  misc_feature: GZ8MTXP02GRR2L.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggacaccaacaatgtcgcgaccagggacgccgcttggctgcagcaacgccacgggcccacccctccccaaactcctgtccgtacaggaatcgaccaaccggccctacaaactactttacacgagtacgtacttttaccacctcaaggtacaacaaaactcacgcctctactagacctattacctacgtctaccacgcctagacgacgacgctcgtaacctactactgcctcgacgtccgtagggaccaccacgtcctcgctgcgttcggtctttcgggacggtacgggacctaacggtccgtacggacccgtccgtcgggtcgaaccggccaacggccgtccgcccccgtcggtcctcccg

SEQ ID NO: 432524 - DNA, 557 bp, Homo sapiens
  misc_feature: GZ8MTXP02HW1GA.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactcctgtccgtacaggaatgactaaccggccctacaaactattcagagagtactttcacctcaaggtacaacaaaatcagcctctctgaccattactgtctccagctgacgacgagctgactactactgtacctcacgtccgtagggaccacccgagcccgtcgctcgtccgttcggtccgtttcgggcggtacgggtaccaacgtcgtacgaccgtccgtcggtacgaacggcccgaacggcctacgtcccccgtcggtcctacccg

SEQ ID NO: 432525 - DNA, 610 bp, Homo sapiens
  misc_feature: GZ8MTXP02FNTEX.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacatgtcggcgaccagggacgccgcttggctgcagcaacgccagggcccaccctcccaaacctcctgtccgtacaggaactggaccaacccggccctacaaaacctactttacagaagtagtaacttttcctacctccaggaacaacaaaaactccacgaccctactacctacgacctattacctggtacctcccagcccgtagaccgacgacggctacgacttactactacgcctacgacgaccgtgggaccaccgaccgcctcgctcggcgttcggtccgttttcgggacgggacggggaccgaacggtccgtacggacccgttccgtcgggtaccaacggtcccgaacggcctccggtccccctcgggtccctacccg

SEQ ID NO: 432526 - DNA, 562 bp, Homo sapiens
  misc_feature: GZ8MTXP02JOMVM.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgccattttagcaggtgtccaatgtgaggtggagttggtggagtcgtgggggaggcttggttcagcctgggagggtccctgagagtctcctgcacagcctctggattcaccttcagtaactatgagatggactggatccgccaggctccgaggaaaggggctggagtggattgcctatgtcacctagtgagggcgaagtcacgtccgtacgccggactcgtggtcggccgggggtcccggtttaccatcctccagagacatcgaccaagaacgacgcttcttctgctagttcggacggcctgacgagtacgaagacgacggactaatttactactggtggtagtaggagggacgggggcacggtggtcgtaggggtcgggtcgtacgtttcgtttgttagg

SEQ ID NO: 432527 - DNA, 560 bp, Homo sapiens
  misc_feature: GZ8MTXP02G28VJ.19.85.H08.1.454.CMB.2.raw
  modified_base (231)..(231): a, c, t, g, unknown or other
  modified_base (250)..(250): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaanaatgtcggcgaccaggganccgctggctgcagcaacgccacggcccaccctcccaaactcctgtcgtacaggaatcgaccaaccggccctacaaactatttacagagagtactttcacctcagacaacaaaatcagcctctctgacctattactcgtctccacgcctagacgacgacggctacgactactactgctcacgcctgggaccaccacgcctcgctcgtcttcggtcgtttccggacgggacgggaccgtaacgccgtacgacccgttccgtcgggtaccgaacgcccgaacggtccgtccgtcccccgtcggtacctacccg

SEQ ID NO: 432528 - DNA, 527 bp, Homo sapiens
  misc_feature: GZ8MTXP02IU164.19.85.H08.1.454.CMB.2.raw
  modified_base (389)..(389): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtcgtccgggggcctgggacaggccgccacagtcacctgcaccggaacacaacaatgcgcgacagggacgccgctggctgcagcaacgcacgggccaaccctccaaactcctgtcgtacaggaatcgacaaccgccacaaacattcagagacgtatttcacctacagacaacaatacacacctctacgtacactattactcgtctaccacnctagacgacgagctagactactactagctacagccgtgggaccaccacgcctcgctgcgtggtcgtttcggcggacggacaagcgttacgaccgtcgtcggtccgacgaccgaacggtcgccgccccgtttcggaccg

SEQ ID NO: 432529 - DNA, 542 bp, Homo sapiens
  misc_feature: GZ8MTXP02HTXFC.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagccgtgggacggtccctgagagtctcctgcacagcctctggattcaccttcagtaactatgagatggactggatccgcaggctccgaggaagggctggagtgatgctatgtcactagtgaggcgaagtcacgtcctagcgactcgtgcgcggggtccgttacatctccagagaacatcgacaaagaagacgtctactttctgctaagttggacggctagagagtacgaagacgacggtacttaatttatacgttggtagtggagacgggagggggacacggtggtcgtgggtcgggtacgtagtttcgttttgtagg

SEQ ID NO: 432530 - DNA, 520 bp, Homo sapiens
  misc_feature: GZ8MTXP02GC0WO.19.85.H08.1.454.CMB.2.raw
  modified_base (335)..(335): a, c, t, g, unknown or other
  modified_base (385)..(385): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatcgacaaccggccctcaaacattccaganacgtactttcacctccaggacaacaaatcagcctctctagacccattacngtacctcgaacgcctgacgcgaggctgactacactgctcagcctgggacaccgagcctcgctgctggctttcggcggtacggaccaagcgttcgaccgtccgtgggtcacgcccgagcctcgccccgtcggtccc

SEQ ID NO: 432531 - DNA, 650 bp, Homo sapiens
  misc_feature: GZ8MTXP02GY4E5.19.85.H08.1.454.CMB.2.raw
  modified_base (249)..(249): a, c, t, g, unknown or other
  modified_base (297)..(297): a, c, t, g, unknown or other
  modified_base (336)..(336): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccaccctcggtgtccgggggcctgggacaggccgccacacgtcacctgcaccggaacacaacatgtcggcgacgaggganccgcttggctggcagcaacgccacgggcccacccgtacccaaactccngtccgtacaggaatcgaaccaaccggccctacgaaactntttacagagtagtacttttacacctacaagacaaacaaaactcaacgtcctactactacgaacctatttaccgtcgtctacccgacgtccgtacgaaccgacgacggcttacgaacctactaaccgttcgaccttacgaacggccctaggggaacccaccgaacggtcctaccgcttcgccgtttcgggttcgtttcgggacggtacgggaacctaacggtccgttacggacccgttccgttcggggtaccaaccgggtacccaaacgggtccgtaacccgtccccccggtttacgggtaccctttaaccccgg

SEQ ID NO: 432532 - DNA, 559 bp, Homo sapiens
  misc_feature: GZ8MTXP02IJG32.19.85.H08.1.454.CMB.2.raw
  modified_base (393)..(393): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggaacaccaacaatgtcggcgaccagggagccgcttggctgcagcaacgccagggcccaccctcccaaactcctgtccgtaacaggaatgaaccaacccggccctacaaaacatttccagagagtactttctacctcaggacaacaaaatccagcctctctgacattactgtcnccagcctgacgtacgacgctagactacactgctcgacgtccgtagggaccaccgagccctcggctcgccttgggtccgtttcgggcggtacgggtaccaaacgtccgtcggtacccgtccgtaggtccaacggcccgaacggtcctcgcccccgtcggtactcccg

SEQ ID NO: 432533 - DNA, 516 bp, Homo sapiens
  misc_feature: GZ8MTXP02FJVO2.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggacaccaacaatgcgcgaccaggagccgcttggctgcagcaacgccaggccaccctcccaaactcctgtcgtacaggaatgacaaccggccctacaacatttcagagagacttttcacctcaggacaacaaatacagcctctctgacctatactgtctccagcctgacgacgagctgactactactgctcagcctagggacaccagcctcgctgcttggtctttcggcggacgggtaccaagctcgaccgtccgtggggtccaaggccccaaggctcgcccccgtcggtccaccg

SEQ ID NO: 432534 - DNA, 716 bp, Homo sapiens
  misc_feature: GZ8MTXP02JQBJY.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtggtccgggggcctgggacaggccgccacagtcacctgcaccggaacaccaacaatgcggcgaccgagggacgccgcttggctgcagcaacgccgacgggccacccctacccaaactcctgtcgtacgaaggaatcgaaccacccggccctacgaaactactttcaaggagaacgttacttttaccaacctaccgaacggtaaacaaactaaaactaaccacgtacccttacctacgtcgtaacctaactttaccgtacgtcccttacccgacgtcccgttacgacggaccggacggtaccgtacggaaccttacgttaaccgtgtacccgttacgaccggtaccggttacggggaacctacccgaaccggcccgttccgccgttcggttccgtttcgggttccggtttttaccggggcggggtaacggggtaaccggtaaacgtaccggttaccggtaccccggttccgtcgggggttaaccgaacccggacccggttaacggcccgttacccggtcccccggttcggttaccccg

SEQ ID NO: 432535 - DNA, 545 bp, Homo sapiens
  misc_feature: GZ8MTXP02G7SN9.19.85.H08.1.454.CMB.2.raw
  modified_base (227)..(227): a, c, t, g, unknown or other
  modified_base (241)..(241): a, c, t, g, unknown or other
  modified_base (308)..(308): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacctcggtggtccgggggcctgggacaggccgccacagtcacctgcacggacacanatgcgcacgagganccgctggctgcagcaacgccagggccaccctccaaactcctgtcgtacaggatcgacaaccggccanaaacattcagagacgtatttcactcagacaacaactacagcctactactgacctattactgtctcacgctcgacgacgacgctagactactactcgctacagtcctacgggacacccgacgccctcgtcgtcgtccgttcggttcgtttacgggacgggtacgggacctaaagccgtacgacccgttccgtcgggtccgacggcccgaacggccctcggcccccgttacggtccccg

SEQ ID NO: 432536 - DNA, 573 bp, Homo sapiens
  misc_feature: GZ8MTXP02JHJ0O.19.85.H08.1.454.CMB.2.raw
  modified_base (254)..(254): a, c, t, g, unknown or other
  modified_base (368)..(368): a, c, t, g, unknown or other
  modified_base (387)..(387): a, c, t, g, unknown or other
  modified_base (449)..(449): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgnttggctgcagcaacgccagggcccaccctcccaaactcctgtcgtacaggaatcgaacaacccggccctacaaactattacagagatactttcacctcaggacaacaaaatcancctctactcgaccattacngtctccagcctgacgacgacggctagactacactgactcagccgtgggacctaccacgtccncgtcgtgcgttcggtcgtttccgggcggaacggggcctaaacggtccgtacggtacccgttccgttaggggaccgtaacgccccgtaaacggccctaccgccccccgttcgggtacctacccgg

SEQ ID NO: 432537 - DNA, 357 bp, Homo sapiens
  misc_feature: GZ8MTXP02IDYXG.19.85.H08.1.454.CMB.2.raw
  modified_base (252)..(252): a, c, t, g, unknown or other
  modified_base (354)..(357): a, c, t, g, unknown or other
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagagagggggcactggctggtcgggtcgatcttttgatttggtggggccaaggatcaagcgtctccgtctcttcagcctccaccaaggcccatcggtcttcccccnggccaccctcctccaagagcacctctggggcacagcgccctgggctgcctggtcaaggctacttcccacgagagtactgagcgggctggcaaggcgcatagnnnn

SEQ ID NO: 432538 - DNA, 733 bp, Homo sapiens
  misc_feature: GZ8MTXP02JJNTW.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccacccgtcggtcggtccgggggcctgggacacggccgccacagtcaccgtgccgaccggaacaccaacaatgtacggacgaccgagggacgccgctggctgcagcaacgccacggccaccccaccaaactcctagtcgtaacgaggaactcgaaccgaacccggtccctacaaaactactttacgaagtacgtacgtattttaccaacccttaccgaacggaaccaaactaaacgtaccaacggtacccttacctacgtacgaacccttaacgttaaccttcggttaccctaccgaccgtacccgtacggaaccggaaccggacggtacgtacggaaccttacgttaaccgtcggactacccgtaacggtcccgtacgggaccacccgacgtaccgtccggtcttccggtccgttacgggtccggttttaccggggacgggtaccgggtaaacccgaacggtacccggtaccggtaacccggttcccggtacgggtaacccgaaccggtaccccggtaaacgggtcccgttaccccggtccccccggttacggttacccccg

SEQ ID NO: 432539 - DNA, 549 bp, Homo sapiens
  misc_feature: GZ8MTXP02HK7F3.19.85.H08.1.454.CMB.2.raw
  modified_base (347)..(347): a, c, t, g, unknown or other
  modified_base (353)..(353): a, c, t, g, unknown or other
  modified_base (394)..(394): a, c, t, g, unknown or other
  modified_base (402)..(402): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctgggagggtccctgagagtctcctgcacagcctctggattcaccttcagtaactatgagatggactggatcccgcaggctcgaggaaaggggctggagtggattgcctatgtcactagngagggnaagtcacgtcctagcggactctgtcgcggggtcccgttacntctcaganacatcgacaagaacgacgcttcttctgctaattggacgctgagagtacgaagacgacggtcttaagtttactacgtggtacggtggaacggtaggggacgggggcgacgtgggtcgtcggggtcgggtcgtagttcgttttaggtgg

SEQ ID NO: 432540 - DNA, 566 bp, Homo sapiens
  misc_feature: GZ8MTXP02GRO5T.19.85.H08.1.454.CMB.2.raw
  modified_base (254)..(254): a, c, t, g, unknown or other
tcagtactctcgtgcacgaccggtgctcgatttagtatcactcagtcgcgggatccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgnttggctgcagcaacgccagggcccaccctcccaaactcctgtcgtacaggaatgaacacccggcctacaaacattacagagacgtatttcctacctccaggtaccaacaaactacagtaccctctactacgacctattaacctgtcctaccacgcctcgacgacgaggctagactactactgctcacgcctagggaccaccgacgcccgtcgcttcggcgtttcgggtccgttttcgggacgggtaggaccgaaacgcgtcgaccgtccgtcggtccgacggacccgacggccgtccgccccgtcggtcccg

SEQ ID NO: 432541 - DNA, 578 bp, Homo sapiens
  misc_feature: GZ8MTXP02IBMDX.19.85.H08.1.454.CMB.2.raw
  modified_base (247)..(247): a, c, t, g, unknown or other
  modified_base (388)..(388): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacacaacatgtcgcgaccaggganccgcttggctgcagcaacgccagggcccaccctcccaaactcctgtcgtacaggaatgacaaccggccctacaaacatttcagagagtacttttacacctcaaggacaacaaaatcagcctctctgaaccattactcgtcnccacgctacgacgacgacggtctcgaacctactactcgtctccgacgtccgtacgggaccaccacgcctcgctcgtcgttcggtcgttttcggcggtacgggaccaacgtccgtacggtacccggtccgttcgggtaccgtaacggccccgaaacggtccctaccggtcccccgtccgggtcctaccccg

SEQ ID NO: 432542 - DNA, 575 bp, Homo sapiens
  misc_feature: GZ8MTXP02IOCB3.19.85.H08.1.454.CMB.2.raw
  modified_base (386)..(386): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctactgaccctcctcactcactctgcagtgtcagtggtccaggcaggactgactcagccaccctcggtgtccgggggcctgggacaggccgcacagtcacctgcacggacacacatgtcgcgaccaggagccgcttggctgcagcaacgccacggccacccctccccaaactcctgtacgtacaggaatcgaacacccggccctacaaactatttacagagagtactttcctacctccagacaacaaaactcagcctctctcgacattactgtcnccagcctgacgagacggctcgaactactactgcctcacgccgtgggacacccgacgcctcgcgtcgtcgttcggtcgttttacgggacggtacggggtaccaacggtccgtacggtacccgttccggtacgggttaccgaacgaccccgaaaggtcccgtaccgtcccccggttcggtacccgtacccg

SEQ ID NO: 432543 - DNA, 515 bp, Homo sapiens
  misc_feature: GZ8MTXP02FTR3F.19.85.H08.1.454.CMB.2.raw
  modified_base (481)..(481): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccaggggagccgcttggctgcagcaacgccagggccaccctcccaaactcctgtcgtacaggaatgacaaccggccctacaaacatttcagagagtacttttcacctcaggacaacaaaatcagcctctctgacattactgtctccagctgacgacgaggctgactactactgctcacgccgtgggaccaccacgcctcgctgcttggtctttcggcggaggaccagctcgaccgtcgnggtcaagcccgaaggctcgcccctcggtctaccg

SEQ ID NO: 432544 - DNA, 571 bp, Homo sapiens
  misc_feature: GZ8MTXP02FX207.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacatgcggcgacagggagccgcttggctgcagcaacgccagggcccaccctcccaaactcctgtcgtacaggaactcgaaccaacccggccctacgaaaaccatttcagagacgtacttttccacctccaggaacaacaaatcacgtcctctctagacctattactgtctcacgctgacgacgaagctacgactactactcgactcgagccgtacgggacaccgacgcctcgctcgtcgttcggtcgtttcgggcggtaacggaccgaacggtcgtcggacccgtccgtacgggtaaccgacggacccgtaacggccctaccggtccccctcggtaccccg

SEQ ID NO: 432545 - DNA, 515 bp, Homo sapiens
  misc_feature: GZ8MTXP02IPI2D.19.85.H08.1.454.CMB.2.raw
  modified_base (321)..(321): a, c, t, g, unknown or other
  modified_base (383)..(383): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccaggcccaccctcccaaactcctgtcgtacaggaatgacaaccggccctanaaacattcagacgagtacttttcacctccaagacaacaaaatcagcctctctgaccattacngtctccagcctgacacgagctagactactactgctcacgcctgggacaccgagcctcgctgcttgctttcggcgagggaccagctcgaccgtcgtcgggtcaagcccgaaggcctcgcccccgtcggtcacc

SEQ ID NO: 432546 - DNA, 683 bp, Homo sapiens
  misc_feature: GZ8MTXP02IR6ZJ.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgcccaccctcgggtcggtcccgggggcctgggacacggcccgccacacgtccaccgtcggaccgaaccgggaaccaaccaaacaagtcggtccggaccgaccgaggggacgccgcgttggctgcagcaacgccacggcccacccctaccccaactcctcgtaccgtacgacggaactcgaaccaacccggcccctaacgaaactactttcaagagtacgttactttccaacctcaagacaaacaaaactcacgtcctactactacgacctattaccgtgtctaccgacgcctagtaccgacgacgggtctacggaacctacctaacgttcgaccttacaaccggtccgtaccgggaccgaaacccgtcgtcccgtcgcgttcggtccgtttcgggtcgtttaccggggacggaaccggggtaccgtaaacgtccggtaccggtacccggttccggacgggttaccaacggacccgaacggtccgtacccggtcccccgtacggttacctccccgg

SEQ ID NO: 432547 - DNA, 549 bp, Homo sapiens
  misc_feature: GZ8MTXP02F6QCR.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggacgccgcttggctgcagcaacgccaggccaccctccaaactcctgtcgtacaggaatcgaccaaccggccctacaaactattcagagtagtactttccacctcagacaacaaaatcaagcctctacctagaaccatttactcgtacctccaacgcctagaccgacgacgctagactactactcgactcacgccgtcgggaaccaccacgcctcgcgtcgcttggtcgtttcgggacggtacggaccaacgcgtacgaccgtcgcggtcaacggccaacggcctccgcccctcggtctaccg

SEQ ID NO: 432548 - DNA, 548 bp, Homo sapiens
  misc_feature: GZ8MTXP02F8H8C.19.85.H08.1.454.CMB.2.raw
  modified_base (228)..(228): a, c, t, g, unknown or other
  modified_base (364)..(364): a, c, t, g, unknown or other
  modified_base (400)..(400): a, c, t, g, unknown or other
  modified_base (417)..(417): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtccggggcctgggacaggccgcacagtcactgcaccgggacaccaanaatgtcggcgaccgagggagccgcttggctgcagcaacgccaggcccaccctccaaactcctgcgtacaggaactgacaaccggccctacaaacatttcagagtagactttcacctcagacaacaaaatcagcctntcctgaaccatttactcgtctccagcctgacgacgngctgactactactgctnacgcctgggaccaccacgcctcgctcgcttcggtctttcgggacgggtacggaccaacggtctacggtacccgtccgtggggtccaacggcccccgaaagggccctaccggcccccgtccggtctaccccg

SEQ ID NO: 432549 - DNA, 583 bp, Homo sapiens
  misc_feature: GZ8MTXP02HJ0BR.19.85.H08.1.454.CMB.2.raw
  modified_base (278)..(278): a, c, t, g, unknown or other
  modified_base (443)..(443): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccgggacacaacaatgtcggcaccgaggagccgcttggctgcagcaacgccaggcccacccnccccaaactcctgtccgtacaggaaatcgaacaacccggccctacaaacatttccagagaagtacttttacctacctccaaggtaaccaaacaaaactcaacgccctactcctagaacctatttactcgtacctccagcctgacgacgaggctagactactactnctcagccgtggacaccagccctcgctgcttcggctttcggacggtacggaccgacgcgtacgacccgttccgtcggggttaccgaacggccccgaaacgggtcccgtaccggtccccccgtcggggtaccccttaacccg

SEQ ID NO: 432550 - DNA, 618 bp, Homo sapiens
  misc_feature: GZ8MTXP02IV6PH.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggaacaccaacaatgtcggcgaccgagggacgccgcttggctgcagccaaacgccgacggcccacccctaccccaaactcctgtcgtacaggaatgaaccgccaaccgaccctaatccaattcgagtatacgtactttaccacgtccaagaacaacaactccacgtccctacgtacctacgtacctattactcgtacctaccgacgaccgtacgacgacgacggtactacgtactacgtactcgactccgacgccgtacgggaccacccgacgccgtcgtcgtcgtcgtttcgggtcggttttacgggacggacgggaccgtaacggtaccgtccggtaccggtccgtacgggtccgaacggcccgacggtcccgtcccggtccccgtaccggttcccg

SEQ ID NO: 432551 - DNA, 612 bp, Homo sapiens
  misc_feature: GZ8MTXP02HV724.19.85.H08.1.454.CMB.2.raw
  modified_base (358)..(358): a, c, t, g, unknown or other
tcagtactctcgtgcacgaccggtgctcgatttagtatcactcagtcgcggggtccaaacagagcttcagcaagcatagtgggaatctacaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccgagggacgcccgcttggctgcagcaacgccaggccaccctccaaactcctgtcgtacaggaatcgacaaccggccctacaaacattcagagagtatttccacctccagaccaanaaaactacacgccttactctacgacctattactcggtcctccaagtccctagacgaacgaggctcgaactactactcgcctacgacgcccgtacgggaccaccgacgcccgtcgcctcgtccgttcggtccgttttcgggacgggtacgggacccgtaaaggtcctacggtacccggtaccgtcggggttaccgacggaaccccgtaaacggccgttcccggcccccgttccggtacccgtaccgtttccccgg

SEQ ID NO: 432552 - DNA, 593 bp, Homo sapiens
  misc_feature: GZ8MTXP02GSRAD.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggacaccaacaatgtcggcgaccagggagccgcttggctgcagcaacgccaggcccaccctcccaaactcctgtcgtacaggaatgacaaccggccctacaaactattacagagagtacttttcacctcaggacaacaaaatcacgacctctactacgaacctattacctcggtcctaccagtcctagacgacgacggctacgaactactactcgctacgacgtccgtgggaccaccgacgcctcgcgttcgccgtttcggtcgttttccgggacgggtacgggacctaaacggtcgtacggtaccggtcccgtacggggtcaaccggtacccgaacgggtcccttaccggcccccgttcgggtccttacccg

SEQ ID NO: 432553 - DNA, 556 bp, Homo sapiens
  misc_feature: GZ8MTXP02ILQZC.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcacggacacacatgcgcgacaggagccgctggctgcagcaacgccagggcccacccctccaaactcctgtcgtacaggaatgacaaccggcctacaaacattcagagagtactttccacctcagacaacaaaatcagcctctctgaccattactgtctccacgcctagacgtacgagctcgactactactgctcaacgtcctacgggacaccgacgcctccgctcgcttcggtcgtttcgggcggtacgggtaccaaacggtccgtacggtacccgtccgttcggggtaccaaccggacccgaaacgggccctccggtcccccgtcgggttacccctacccg

SEQ ID NO: 432554 - DNA, 536 bp, Homo sapiens
  misc_feature: GZ8MTXP02J4G0F.19.85.H08.1.454.CMB.2.raw
  modified_base (281)..(281): a, c, t, g, unknown or other
  modified_base (295)..(295): a, c, t, g, unknown or other
  modified_base (332)..(332): a, c, t, g, unknown or other
  modified_base (354)..(354): a, c, t, g, unknown or other
  modified_base (374)..(374): a, c, t, g, unknown or other
  modified_base (397)..(397): a, c, t, g, unknown or other
  modified_base (404)..(404): a, c, t, g, unknown or other
  modified_base (406)..(406): a, c, t, g, unknown or other
  modified_base (419)..(419): a, c, t, g, unknown or other
  modified_base (426)..(426): a, c, t, g, unknown or other
  modified_base (441)..(441): a, c, t, g, unknown or other
  modified_base (449)..(449): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgcttgggttttccttgtcgcttattttagcaggtgtccaatgtgaggtggagttggtggagtcgtgggggagtcttggttcagccgtgggacgggtccctgagacgtctcctgcacagcctctggacttcaccttnaagtaactatgagntggactggactcccgcgaggctacgaagggaacgggntggagtggatgctatgcacagngaggcgatcacgtccagcgntgtgcgcggggtcccttacatcncagacanancgacaagaacgcncttcttngactagtggacgtcngacggtanacgaacgtcgacgtattaatttactagtgtagagacggagggacggggcctaggtggcgtggggtccgtgtacgtttcgtttagtgg

SEQ ID NO: 432555 - DNA, 668 bp, Homo sapiens
  misc_feature: GZ8MTXP02H2305.19.85.H08.1.454.CMB.2.raw
  modified_base (245)..(245): a, c, t, g, unknown or other
  modified_base (250)..(250): a, c, t, g, unknown or other
  modified_base (329)..(329): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctggggacaggccgccacagtcacctgcaccgggaacacaacatgcgcgaccaggngccgnttggctgcagcaacgccaggccccaccctcccaaactccctgtcgtacaggaactgaaccaacccggccctacaaactntttacagagagtacttttccacctccgaagacaacaaaatcagccctctctagacctatttacctacggtcctaccgacgtacccgttacggaaccgaaccggtaacggtccgtacggtaacccttaaccgtaccttacggtacccttaccgaacggttacccgttacggggaaccaacccgagtccccgtcgtccgtggtccgtttcggtccggtttttccgggaccggacggggtaccctaaacggtccgtacggtaccccggtccggttcggtaccgaaccggccccgtaaacggtcccgtacccggacccccccgtttcggtacccgttaccccg

SEQ ID NO: 432556 - DNA, 761 bp, Homo sapiens
  misc_feature: GZ8MTXP02FW29K.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccgagggacgccgcttggctgcagcaacgccacgggcccaccctaccccaaactccctgtaccgtacacggaactcggaaccaacccggacccctacaaaaccgtatttaccgagtaaacgtacgtaacctttttacctaaccctcaacggaacaaaccaaaaataccacgaccctacttacctacgtaaccctaatttacctcggttaccctacccgacgtacccgttaggaacccgtaacggacggtactacggaaccttaaacctaccttacggtacctaccgtaaacggtccccttacgggggaacccaacccgaaccggtcccctaccggtccgttcgttcccgtttacggggttacccgtttttccgggggaccggggtaaccggggtaaacccggtaaacggtcccgttaccgggtaccccgttacccggttcggggttacccgaaccggtacccccgaaacggggtccccgttacccggtcccccccgtttaccggggtccctttaccccgg

SEQ ID NO: 432557 - DNA, 685 bp, Homo sapiens
  misc_feature: GZ8MTXP02IIP3Y.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccaccctcgggtcggtccgggggcctgggacacgggccgccacacgtccaccgtgaccgaccgggaacaccaacaagtcgtccggacgaccgagggacgccgcgttggctgcagacaaccgccgaggccccaccccgtaccaaacctcctcgtcgtacaggatacgacaacccggccctacaaactatttaccgaagtacgtacgttactttccgaacccttaccgaacggaaccaaacctaaataccacgtacccttcctactacgaacctaacgttactcggtccttaccgagtcccttagaccgaccggtacgtctacggaccttacgtaacctgacccgtctacggcccgttagggaccctaccgacgtcccgtcgtccgtggtccgtttcgggttccgtttacgggacgggtaacggccgtaaacggtccgttaccggtacccgttcggacgggttaacccgaccggacccgtaacggtccgtaccccggtaccccgtcgggttaccccg

SEQ ID NO: 432558 - DNA, 753 bp, Homo sapiens
  misc_feature: GZ8MTXP02HOO47.19.85.H08.1.454.CMB.2.raw
  modified_base (239)..(239): a, c, t, g, unknown or other
  modified_base (243)..(243): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggacacaacatgcgcgacnggancgctgctgcagcaacgccacggccacccctccgaaactccgtgtccgtacaggactcgaaccaacccgggccctacgaaaactactttaccgaagtacgacgtacttttaccgacctacgaaggtaccaaacaaacgtaccgactacctaccgttacgtacctaccttaacgttaccgtacggtaccctaccgaccgtccgttacggaaccggtacggtacgtaccgtacgtaaccttaccgtaccgtccgtaccgtacgtaccgtaccgggttaccggaaccgacccggtaccgtccccggtaccggtcgttaccggttaccgggttcccggttttcccggggtttaccgggggaaccggggttaaccggtaaaccggttaaccgggtccgttaaccccgggttccccggttaacccggggttccgggttaacccggtacccgggaaccccggggtaacccggttacccggttaccccccggtccccggtttaaccggggttacccccg

SEQ ID NO: 432559 - DNA, 824 bp, Homo sapiens
  misc_feature: GZ8MTXP02HN9Y8.19.85.H08.1.454.CMB.2.raw
  modified_base (262)..(262): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtcggtccgggggcctgggacagggcccgccacagtcacctgaccaccggaacaccaacaatgtccggcgaccgagggagccgntggctgcagcaacgccacggcccacccctcccaaacctccgtgtaccgtaacgaacggaactcgaaccgaaccccgggtcccctaactaaaaacctacttttaccgaagaacggtaaccgttaactttttacctaacccgttacccgaaaggaaacccaaaactaaaactaccaacgtaccccttccgttacctacggtaaacccttaacttaaccgttacgggttacccttacccgtacggtacccgttacgtaacccggtaaccggaacggtaccgtacggtaaccttaaccgttaacctaccgttaccgtaccgtaaccggtacccggttaccggggaaccctaccccgaaaaaccggtccccgttaccggtcccgtttacggtccgttttccggggttccggtttttaaccgggggccgggttaaccgggggaaacccggtaaacggtccggttaccggtaacccggttcccggtaccggggttaacccgtaccgggaaccccggtaaccgggtacccggtaccccggttaccccccggttaccggggtttacccccg

SEQ ID NO: 432560 - DNA, 596 bp, Homo sapiens
  misc_feature: GZ8MTXP02FY0B3.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcacggaacacaacatgtcggcgacagggagccgcttggctgcagcaacgccgacgggcccaccctccccgaaactccgtgtacgtacaggaactcgaaccgaacccggccctacaaactattcagacgagtacttttcacctcaacgacaacaaatcacgcctactactcgacctattactgtcctacacgtcctcgacgacgagctagactactacgtcgctacgcgtaccgtcgggaaccaccgacgcccgtcgccttgtccgtttcgggtccgttttaccggggcggtacgggaccctaacggtccgtacggtacccgtccgttcgggtaaccgacggacccgtaacggcccgttcccggcccccgttcggttacccg

SEQ ID NO: 432561 - DNA, 534 bp, Homo sapiens
  misc_feature: GZ8MTXP02FFVZS.19.85.H08.1.454.CMB.2.raw
  modified_base (368)..(368): a, c, t, g, unknown or other
  modified_base (372)..(372): a, c, t, g, unknown or other
  modified_base (418)..(418): a, c, t, g, unknown or other
  modified_base (445)..(445): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgctggctgcagcaacgccagggccaccctcccaaactcctgtcgtacaggaatcgacaaccggccctacaaacatttcagagacgtattttccacctccaggacaacaaatacancctntctgaccattactgtctccagcctgacgacgagctgactactactnctcacgcctgggacaccacgcctcgcngcttcggccttttcgggcggacgggaccgaacgctcgtacccgtccgtcgggtccgacgacccgacggccgtcgcccccgtcggtaccc

SEQ ID NO: 432562 - DNA, 532 bp, Homo sapiens
  misc_feature: GZ8MTXP02IM05N.19.85.H08.1.454.CMB.2.raw
  modified_base (223)..(223): a, c, t, g, unknown or other
  modified_base (318)..(318): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggctgggacaggccgcacagtcactgcacggacacanatgtcgcgacaggagccgcttggctggcagcaacgccacgggccacccctccccaaactcctgtcgtacaggaactgacaccggccctacaaacnttcagagagtacttttcacctaccagacaacaaaatcagcctactctcgacattactcgtctccaagcctagacgacgacggctcgactactactgactcaacgcctagggacaccacgcctcggctcgcttgcgtttcggcgtacgggaccacgtacgtcgtaccgtcgtcggtcgaacgcccgaaggtcctcggccccctcggtcctacccg

SEQ ID NO: 432563 - DNA, 569 bp, Homo sapiens
  misc_feature: GZ8MTXP02JDRVG.19.85.H08.1.454.CMB.2.raw
  modified_base (247)..(247): a, c, t, g, unknown or other
  modified_base (280)..(280): a, c, t, g, unknown or other
  modified_base (305)..(305): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtccgggggcctgggacaggccgccacagtcacctgcacggaacaccaacatgcgcacaggagccgntggctgcagcaacgcaggccacctccaactccngtcacaggatgacaccgccacaacnttcagagagtactttcacctcagacaacaaatcagcctactctacgacctattactacgtcctaccgagcctagacgtacgacggtctcgtaactactaactcgaccttcgaacgtcccgtacgggacccaccgacgtccctacgtcctgtcgtttcggtccgtttcggggcggtacgggacctaaacggccgtacggacccgtaccgtcgggtaccaacggacccgaacggtccgtacccgtcccccgtcggtaccctacccg

SEQ ID NO: 432564 - DNA, 564 bp, Homo sapiens
  misc_feature: GZ8MTXP02JB466.19.85.H08.1.454.CMB.2.raw
  modified_base (224)..(224): a, c, t, g, unknown or other
  modified_base (234)..(234): a, c, t, g, unknown or other
  modified_base (241)..(241): a, c, t, g, unknown or other
  modified_base (245)..(245): a, c, t, g, unknown or other
  modified_base (274)..(274): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcactgcacggacacanatgcgcgacnggagcgntgcngcagcacgcacggccaccctccaactccngtactacaggaatcgacaaccggccctacaaacgtactttcgaagacgtaagtactttttaccacctcaacggaacaaccaaaattcacgtcctctacctacgaaccctattacctacgtcctaccagcctagacgacgacgctacgactactactcgactcgacgtccgtacgggaccaccacgcctcgcgtgcgttcggtcgtttcggacggacgggaccaacggcctacgtacccggtccgtcggtccgaacgcccgaacggcctccggccccctcggtcctacccg

SEQ ID NO: 432565 - DNA, 509 bp, Homo sapiens
  misc_feature: GZ8MTXP02FF8EZ.19.85.H08.1.454.CMB.2.raw
  modified_base (393)..(393): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaacccggccctacaaacattcagagacgatttttccactccaggacaacaaatacagcctctctgaccattactggtctccancctgacacgaggctgactactactgctcagcctgggacaccagcctcgctgcttggctttcggcggtagggaccaagctcgaccgtctgggcagcccaggctcgccccctcggtcc

SEQ ID NO: 432566 - DNA, 637 bp, Homo sapiens
  misc_feature: GZ8MTXP02FXZLP.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgcccacccgtcgggtcggtccgggggcctggggacacgggccgccacacgtcacctgaccgaccggaacaccaacaatgtcggcgaaccgagggacgccgcgttggctgcacgcaaccgccgacgggcccaccccgtacccaaactccgtgtaccgtacaggaaatcgaacccgaacccggccctaacaaaacctattaccgaaagacgtacgttaactttccaaccctcgaaggacaaacaaagtcacgtccctctctacgacctattactggtccctccgacgacctacgaccgacgaggctacgacctactacgtacgtctacgacgccgtacgggaccaaccgacgtccgtcgacgttcggtcgtttcggtccgtttacggggacggtacgggactaacggccgtacgtacccggttcgcgggtaacgccggacgtacgggcctacggtcccccgtcgtacccg

SEQ ID NO: 432567 - DNA, 544 bp, Homo sapiens
  misc_feature: GZ8MTXP02F97XW.19.85.H08.1.454.CMB.2.raw
  modified_base (244)..(244): a, c, t, g, unknown or other
  modified_base (321)..(321): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggctgggacaggccgcacagtcacctgcacggaacacaacaatgtcgcgaccaggganccgcttggctgcagcaacgccagggccacccctcccaaactcctgtcgtacaggaatgacaaccggccctacaaacntttcagagagtactttcacctcaggacaacaaaatcagcctctctagaccattactgtctccacgtcctgacgacgagctacgactactactgctcacgccgtgggacctaccacgccctcgctgcttggtctttcgggacggtacgggacccaaggtccgtacgtacccgtccgtcgggtccaacggtccccgaaggcctcgcccccgtcggtaccctcccg

SEQ ID NO: 432568 - DNA, 541 bp, Homo sapiens
  misc_feature: GZ8MTXP02FTTIO.19.85.H08.1.454.CMB.2.raw
  modified_base (373)..(373): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccaggcccacccctcccaaactcctgtcgtacaggaatgaccaacccggccctacaaactatttcagagagacttttccacctcaggacaacaaaatcagcctntctgaccattactgtctccagcctgacgacgacgctgactactactgcctcacgcctgggacaccgacgccctcgcgtgtcttggtccgtttcgggcggtacgggacaaggcctcggaccgtcgtcggtcaacgcccgaaggcctccgtcccccgtcggtcctacccg

SEQ ID NO: 432569 - DNA, 636 bp, Homo sapiens
  misc_feature: GZ8MTXP02H99L5.19.85.H08.1.454.CMB.2.raw
  modified_base (284)..(284): a, c, t, g, unknown or other
  modified_base (459)..(459): a, c, t, g, unknown or other
  modified_base (608)..(608): a, c, t, g, unknown or other
  modified_base (619)..(619): a, c, t, g, unknown or other
  modified_base (632)..(632): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctctcactcactctgcagtgtcagtggtccaggcaggactgactcagccaccgtcggtcggtccgggggcctggggacacgggcccgccacacgtccaccgtgaccgaaccgggaacaccaaacaagtcggtaccggccgaacgaggggacgccgtcgttggcngacagaccgaacgccgagggccccaaccctacccaaacctccgtagtaccgtaacacgggaatcggaaccctaacccggccctacaaactattcgaagtagagttacctttaccgaacctcaacggtacaaactaaaacgtcaacgtacctcttacctacgaaccctatttaccncggttcctaccgacgtccgtagacccgacggtaggctacgaaccgtacttaacgcggtacttaccgaacgtccgtacgggacccacgaccgtccgcgctcggtcgttcgggtcgtttacggcggacggtcacgtcgcgacgtcgtggcncgccgacgtcnccgtccgcgttcncccg

SEQ ID NO: 432570 - DNA, 581 bp, Homo sapiens
  misc_feature: GZ8MTXP02G7Y3O.19.85.H08.1.454.CMB.2.raw
  modified_base (329)..(329): a, c, t, g, unknown or other
  modified_base (559)..(559): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggctgggacaggccgccacagtcacctgcgaccggaacaccaacatcgcggcgacgagggacgcgctggctgcagcaacgccgacggcccaccctacccaaactctcgtcgtacaggatcgaaccaaccgaccctacaaactnttacagagtacgtacttttaccacctcgaacgaacaacaaaactccacgtcctactactacgacctattaacctcgtacctccacgacctggaaccgacggacgctacgaactacgtaactcgctcgaacgtccgtacggaccaccgacgtcctacgctcggtcgttacggtcgttacgggcggacggtacgacgcgtccgaccgtccgtggtaccaacgccgacggtcncccgaccccgtcggtactcccg

SEQ ID NO: 432571 - DNA, 692 bp, Homo sapiens
  misc_feature: GZ8MTXP02HXS4X.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtcccgggggcctggggacaggccgccacagtccacctgcaccgggaacaccaacaatcggtcggcgaccgagggagccgcttggctgcagcaacgccacggcccacccacccaaactcctgtaccgtacaggaactcgaaccaacccggccctacgaaactattccgaagagagtacttttaccacctacgaaggaacaacaaaatacacgtacctactacctacgaacctactttaaccgtcgttccctaccctaacgtcccgttacggaaacccggaccgacggtccgtacgtaaccttactaacctcgtccttaccgacgtcccgtacggggaacctacccgacgcctcgcgtcgtccgttcgggtccgttttcggggacggggtacgggtaacccgtaaacggtccggttaccggtacccgtcccggttacggggtaccgaacccgggtacccggtaacgggtccccggtacccggtcccccccggttaccggttcccgtaaccccg

SEQ ID NO: 432572 - DNA, 583 bp, Homo sapiens
  misc_feature: GZ8MTXP02H3AVC.19.85.H08.1.454.CMB.2.raw
  modified_base (336)..(336): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctggggacaggccgccacagtcacctgccaccggaacaccaacaatgtcggcaccgaggagccgcttggctgcagcaacgccacgggcccacccctccccaaactccctgtccgtacaggaatgaaccaacccggcccctacaaacntttacagagagtactttcacctcagacaacaaatcagcctactactcgactattactgtctccacgcctagacgacgacgctagacctactactgcctcaacgtccgtacgggaccacccgacgccctcgctcgtcgttggtccgtttcgggcgggacgggaccaacgtccgtacgtacccggtcgtcgggtaccgaacggccccgtaacgggcccgtcccggacccccgttcggtacccttacccg

SEQ ID NO: 432573 - DNA, 598 bp, Homo sapiens
  misc_feature: GZ8MTXP02GRWYE.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccaggcccacccgtccaaactcctgtacgtacaggaactcgaaccaacccggccctacaaactatttaccagacacgtacttttccacctaccaaggtaaccaacaaagtaccaacgtcccttactactacgaacctattactcggtacctccacgcctgacgacgaggctagtactactactcgctacgagccgtagggaccaccgacgcccgtcgctcggtcgttcggtccgtttcgggacggtacgggaaccgtaagccgtacgaccgtccgtacggtaaccgaccgtaccgacggtccgtacccggtcccccgttcggtacccg

SEQ ID NO: 432574 - DNA, 541 bp, Homo sapiens
  misc_feature: GZ8MTXP02GQIEX.19.85.H08.1.454.CMB.2.raw
  modified_base (295)..(295): a, c, t, g, unknown or other
  modified_base (374)..(374): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccgggaacaccaacaatgtcggcgaccagggacgccgcttggctgcagcaacgccagggcccaccctacccaaactccngtctacaggaatgacaaccggccctacaaacatttcagagtagactttcacctcagacaacaaaatacagcctactctnaacctattacctgtctccacgcctgacgacgaggctagactactactgctcacgtcctacgggaccaccacgtccctcgctgcgttggtctttcgggcggacgggacaacgcgtacgacccgtacgtgggtcaacgcccgaacggcctcgccccgtcggactacccg

SEQ ID NO: 432575 - DNA, 617 bp, Homo sapiens
  misc_feature: GZ8MTXP02IROFG.19.85.H08.1.454.CMB.2.raw
  modified_base (380)..(380): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccccggtggtccgggggcctggggacaggccgccacagtccacctgccaccgggaacaccaaacaatcgtcggcgaccgaggggacgccgcttggctgcagcaacgccacggcccaccctcccaaactcctgtcgtacaggaactcgacaaccggccctacaaactattcagagagtactttccctacctcagacaacaaaacttacncgtcctactctacgaacctatttactcggtacctccgcctcgacgacgaggctacgactactactgctcacgtccgtagggaccacccgacgccctcgccttcggtcgtttcgggtccgttttacggggcgggtaacgggaccgtaggtccgtcggtacccgttcggtcggggtccaaccggtacccgaacggtcccgtcccggtcccccgttcggtaccctacgtccgtttccccg

SEQ ID NO: 432576 - DNA, 586 bp, Homo sapiens
  misc_feature: GZ8MTXP02FYNFJ.19.85.H08.1.454.CMB.2.raw
  modified_base (249)..(249): a, c, t, g, unknown or other
  modified_base (460)..(460): a, c, t, g, unknown or other
  modified_base (490)..(490): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcgggtcgtccgggggcctggggacaggccgccacagtcacctgcaccggaacaccaacatgcggcgaccaggngcgctggctgcagcaacgccaggccaccctcccaaactcctgtcgtaacagggaatcgaaccaaacccggccctaccaaaactactttcgaagatacgtactttttaccaacccgtacgaacgaaccaaaacaactacgactcctacctcgtaacactacttacgtcgtacctcgactccagacgacgacggtctacgtaaactacgtacncgtctacgacgcgtacggacaccgcgtccncgctcgtcgttcggttcgttacgggacgggtacgaacgacgtcgtacgtaccgtcggtcggtcgaccgtacgacgtccgtcccgtcccgtcgtccg

SEQ ID NO: 432577 - DNA, 603 bp, Homo sapiens
  misc_feature: GZ8MTXP02G5W35.19.85.H08.1.454.CMB.2.raw
  modified_base (241)..(241): a, c, t, g, unknown or other
  modified_base (346)..(346): a, c, t, g, unknown or other
  modified_base (377)..(377): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcatcactcactctgcagtgtcagtggtccaggcaggactgactcagccaccctcgggtcggtccgggggcctggggacacggcccgccacacgtccacctgaccaccgggaacaccaanaatcggtcggcgaccgagggagccgcgttggctgcagcaacgccagggcccacccctaccaactcctgctacaggatgaccacccggcctacaactattacaganacgtatttccacctcagacaacaactacacncctctctacgacctattacgtcgtccctacacgtcgtacgacggtaccgagtacctacgacctaactacgtcgtctaccacgtccgtacgggaccaacccgccggtcctcgcctcggttaccgttcgggtccgtttaccgggaccggtacgggaccgtagccggtccgtacccgtccgtcgggtccgacgacccgtacgtcccgtcccgtccccgtacggtccccg

SEQ ID NO: 432578 - DNA, 591 bp, Homo sapiens
  misc_feature: GZ8MTXP02I7FKY.19.85.H08.1.454.CMB.2.raw
  modified_base (394)..(394): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagcttggttcagcctgggaggtccctgagagtctcctgcacagcctctggattcaccttcagtaactatgagatggactggatccgcaggctccgaggaagggctggagtggattgcctatcgtcactagtgagggcaagtcacgtcctaacggcgactcgtgtggccggggtccgttacnctcctccagagacaagtcgaccaaagaacgacgtcttaccttcgtgacgtaagttcgggaccgtccgtaggagacggtacgaaacgaccgacggtacttaagtttacttacgttggtacggtagtaaggagggaacgggggtcaacggttggcggttacggggttccggggtagtacgtttcggtttagtttacggg

SEQ ID NO: 432579 - DNA, 535 bp, Homo sapiens
  misc_feature: GZ8MTXP02FP67G.19.85.H08.1.454.CMB.2.raw
  modified_base (397)..(397): a, c, t, g, unknown or other
  modified_base (428)..(428): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctggagggtccctgagagtctcctgcacagcctctggattcaccttcagtaactatgagatggactggatccgccaggctccgaggaaaggggctggagtggattgcctatgtcactagtgagggcaagtcacgtccacgcggactcgtgtgccgggggtccgtttaccntctcagagacaatgcaagaagacgctcttcnacagttggacggctagagagtcgaagacgacggcttaatttacttacgtgtgtggaggtaggacgggggcacgtggcgtgggtcgggtcgtagttcgtttgtttagg

SEQ ID NO: 432580 - DNA, 533 bp, Homo sapiens
  misc_feature: GZ8MTXP02ISKAG.19.85.H08.1.454.CMB.2.raw
  modified_base (227)..(227): a, c, t, g, unknown or other
  modified_base (317)..(317): a, c, t, g, unknown or other
  modified_base (432)..(432): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcacggacacaanatgcgcgacaggagccgcttggctgcagcaacgccgacgggccacccctaccccaaactcctgtcgtacaggaatcgacaccggccctanaacacttcagagagtactttcacctcagacaacaaactcagcctctactcgacattactgtctccacgcctgacgacgagtctgactactactcgctcacgtcctgggacaaccncgcctcgctcgcttcggtcgtttcggcggacgggaccacgctacggtccgtccgtcggtaccgcgtaccccgaaggtcctccgccccgtcggtacctcccg

SEQ ID NO: 432581 - DNA, 603 bp, Homo sapiens
  misc_feature: GZ8MTXP02JHBQQ.19.85.H08.1.454.CMB.2.raw
  modified_base (250)..(250): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgcggcgaccgaggganccgctggctgcagcaacgccagggcccaccctcccaaactcctgtccgtacgaggaatcgactaacccggcccctacaaactatttccagagtagtacttttccacctccaaggacaaccaaaatcacgccctctcctacgacctattactggtctccagcctgacgacgacggctcgactactacgtcgcctcacgtcccgtacgggaccaacccgacgcccgtcgccgtcggtaccgttggttcccgtttcggggaccgggtacgggaccaaacggtcgtaccggtacccggtccgtcgggtacgaacggccccgaacgggtcccaccggtcccccgtcggtccctacccg

SEQ ID NO: 432582 - DNA, 614 bp, Homo sapiens
  misc_feature: GZ8MTXP02FRBG4.19.85.H08.1.454.CMB.2.raw
  modified_base (257)..(257): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccacccgtcgggtcggtcccgggggcctgggacacggccgccacagtcacctgccaccggaacaccaacatgcggcgacgagggacnccgcttggctgcagcaacgccacgggcccaccctcccaaactcctcgtcgtacaggaatcgaccgaacccgccctacgaaactattacagtagacgtacttttaccaccgtaccaaggtaaccaactaaacgtcacgtcctaccgtctacgacctattacgtgtacctcacgtcctagacgacgagctacgactactactcgctacgacgtccgtacgggaacctacccgacgccgtcgtctcgtcgttcggttccgtttcgggacgggtacggaccgaacgtccgtaccgtaccgtccggtcgggtaaccgaccggtacccgaacggtccgtacccggtcccccgtcggttacccg

SEQ ID NO: 432583 - DNA, 576 bp, Homo sapiens
  misc_feature: GZ8MTXP02FGDB5.19.85.H08.1.454.CMB.2.raw
  modified_base (543)..(543): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtggtccggggcctgggacaggccgccacagtccacctgccgaccgggaacaccaacaagtgtcggcgaccgaggggacgccgctggctgcagcaacgccaggcccacctccaactcctgtcgtacgagatcgaccaacccggccctacaaactactttacgagagtacgtacctttttaccaccctacaggaaccaacaaaacgtcaacgccctctactacgaacctacttacgtcgtcctaccacgtcctagacgacgaggctacgactactacgtcgctacgacgccgacgggaccaccgaccgcctcgctggtccgtggttccgtttcgggacggacgggaccaacgcgtcgaccgtcgnggtcaacgccgacggcctccgcccgtcgctccg

SEQ ID NO: 432584 - DNA, 577 bp, Homo sapiens
  misc_feature: GZ8MTXP02I7T02.19.85.H08.1.454.CMB.2.raw
  modified_base (285)..(285): a, c, t, g, unknown or other
  modified_base (304)..(304): a, c, t, g, unknown or other
  modified_base (315)..(315): a, c, t, g, unknown or other
  modified_base (319)..(319): a, c, t, g, unknown or other
  modified_base (358)..(358): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtgtccgggggcctgggacaggccgccacagtcacctgccaccgggaacaccaacaatgtcggcgaccgaggggacgccgcttggctgcagcaacgcacggccaccnccaactcctgtcgacagangacaccgccanaacnttacagagatactttcacctcagacaacaaatcagcctntcctacgaacctattactcggtcctaccgacgcctaggaccgacgacgggtcctacgaacctactactacgaccttacgacgtccgtacgggaccaaccgacgcctcgcgtcgtcgtttcggtcgtttcggcggtacggtaccaacggtcgtacggacccgtccggtacggtaccgaacggtacccgaacgtccgtcccgtccccgtcggtacctcccg

SEQ ID NO: 432585 - DNA, 590 bp, Homo sapiens
  misc_feature: GZ8MTXP02JBA0Q.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccacccgtcccaaactcctgtcgtaaccaggaactcggaaccaacccgggccctacaaaactatttccaagagacgtatttccacctacaggaacaacaaatcagcctctctacgaccattaactgtctaccagcctagacgacgaggctacgactactactgctcacgccgtcgggaccaccgacgccctcgtcgtcgtcgtttcggcgttttcgggacggacgggtaaccaaacggtccgtacgtaacccgtccgttacggggtcctaaccggacccgaaacggtccgtacccgtcccccgtcggtacccg

SEQ ID NO: 432586 - DNA, 642 bp, Homo sapiens
  misc_feature: GZ8MTXP02JDAXB.19.85.H08.1.454.CMB.2.raw
  modified_base (116)..(116): a, c, t, g, unknown or other
  modified_base (260)..(260): a, c, t, g, unknown or other
  modified_base (302)..(302): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctccngaccctcctcactcactctgcagtgtcagtggtccaggcaggactgactcagccaccctcggtcgtccgggggcctgggacaggccgccacagtcacctgccaccgggaacaccaacaatgtcggcgacagggagccgctggcngcagcacgccacggcccaccctcccaactcctgtacgtacgnggaatcgaaccaaccgccctacaaacattacaagagtagtacttttacacctcaacggaactacaaaataccagtccctctcctagacctacttaccgtcgtcctaccctaacgtaccgtacgacgaccgtacggaccgtacgtacctacgtacctacgacgtcccgtacggaccctaccggaccgtacccgtacggcccgtcgtccgttcggtccgtttcgggtcggtttaccggggtacccggaacgggtaccgtacggtaccggtccggtaccggtacccgtacggtcccgaacggtacccgtaccggtaccccgtccggtaccccgtacccgtccg

SEQ ID NO: 432587 - DNA, 617 bp, Homo sapiens
  misc_feature: GZ8MTXP02IXS4A.19.85.H08.1.454.CMB.2.raw
  modified_base (337)..(337): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtgtccgggggcctgggacaggccgcacagtcacctgcaccggaacacaacatgcggcgacagggacgccgcttggctgcagcaacgccgacggcccacccctaccccaaactcctgtaccgtacgaggaactcgaaccaacccggccctacgaaactntttacagagtagtactttacacctcaagacaacaaaatcacgcctctactacgacctattacctcgtcctaccacgtccgtagaacgacgacggtctacgacctactacgtcgacttaccgacgtccgtacgggaaccacccgacgtcccgtcgccgtcggtccgtttcgggtccgtttcgggaccgggacggtaccgaacggtccgtacggtacccgtccggtacggtccgaacggccccgaacggtcccgcccgtcccccggtcggtacccttacccg

SEQ ID NO: 432588 - DNA, 690 bp, Homo sapiens
  misc_feature: GZ8MTXP02H2P6W.19.85.H08.1.454.CMB.2.raw
  modified_base (225)..(225): a, c, t, g, unknown or other
  modified_base (246)..(246): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtggtccgggggcctgggacaggccgccacagtcactgcaccggaanaccaacatgcgcgaccagganccgctggctgcagcaacgccgacgggccaccccgtcccaaactcctcgtcgtaacaggaactcgaaccgaacccggccctacgaaactaactttccgaagagtacgtacttttaccgaccttaccgaaggtaacctaaacaaacgtaccaagtacccctactaccttacgaacctaaacgtttaccgtacggtacccttacccgaaccgtacccgtacggtaaaccggaaccgggacgggtaccgtacggtaaccgttaaccttaccgttacggtccttaccgacgtacccgtacggggacccaccgacgtcccgtccgcttcgtcgttcggttccggttttcgggacgggtacgggaacctaaacggtccgtacggtcccgttaccggtcgggttccgacggacccggacggtcccgtcccggtcccccgttacgggtccccg

SEQ ID NO: 432589 - DNA, 551 bp, Homo sapiens
  misc_feature: GZ8MTXP02FXAQA.19.85.H08.1.454.CMB.2.raw
  modified_base (280)..(280): a, c, t, g, unknown or other
  modified_base (397)..(397): a, c, t, g, unknown or other
  modified_base (409)..(409): a, c, t, g, unknown or other
  modified_base (430)..(430): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagcttggttcagcctgggaggtcctgagagtctcctgcacagcctctggattcaccttcagtaactntgagatggactggactcccgcaggctccgaagggaaacggggctggagtggattgcctatcgtcacgtagtgaggcgaagtcacgtcctacgcgactcgtgcggcggggtcgttacntctcagagacancgacaagacgacgctacttcngacagttggacgcgtgagtagtacgaagacgacggtacttaatttagttacgtggtgtaggacggagggacgggggctacggtggtcggtcgggtcgggtcgtacgttcgtttagttacgg

SEQ ID NO: 432590 - DNA, 545 bp, Homo sapiens
  misc_feature: GZ8MTXP02GOSP4.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccccgtcccaaactcctgtcgtacaggaatgacacccggccctacaaacattcagagacgatttcacctccaggacacaatcagcctctctgaccattactgtcctccagcctgacgacgagctcgactactactcgctcagccgtacgggaccaccgacgccctcgctgtcgttcgggtccgttttcgggcggtacgggaccgtaacgccgtcgtacccgtccgtcgggtcgacgccgaacggccgtccgccccgtcggtacccg

SEQ ID NO: 432591 - DNA, 604 bp, Homo sapiens
  misc_feature: GZ8MTXP02HM5XV.19.85.H08.1.454.CMB.2.raw
  modified_base (251)..(251): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcacgcccaccctcgggtcggtccgggggcctgggacacggcccgcacagtcacctgcaccggaacaccaacatgcgcgacgaggnccgctgctgcagcaacgccgacggcccaccctacccaactccgtgtacgtaccaggaactcgaaccaacccggcctacaaactattcagagacgtactttccacctacaagacaacaaacgtcatcctacacctagaacctattactgtcctcacgcctagacgacgaggctagactactactgactcacgccgtacgggaccaccgacgtcctcgcgtgtccgttgggtccgtttccgggacgggtacggaaaccgacggtaccgtaccggtaccccgttccggttacgggtaacccgaaccgttacccggaaaccggtcccgtccccggtcccccgttaacgggttccccc

SEQ ID NO: 432592 - DNA, 548 bp, Homo sapiens
  misc_feature: GZ8MTXP02GF4HA.19.85.H08.1.454.CMB.2.raw
  modified_base (455)..(455): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttgggttcagcctgggagggtccctgagagtctcctgcacagcctctggattcaccttcagtaactatgagatggactggatccgcaggctaccgaggaagggctggagtggattgcctatgtcactaggtgagggcgaagtcgacgtcctacggcggtactcgtgtcggcggggtccgttacatcctcgagagacatcgaccaagagacgctcttctgctaagttggacggtctgagngtacgaacgtacgacggtattatttatacgttgtcgtaggagacgggtagggggctacgtggtcgtcggtcggtcgtagttcgtttgttacgg

SEQ ID NO: 432593 - DNA, 713 bp, Homo sapiens
  misc_feature: GZ8MTXP02GSEMR.19.85.H08.1.454.CMB.2.raw
  modified_base (233)..(233): a, c, t, g, unknown or other
  modified_base (246)..(246): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggaccaggcccgccacagtcacctgccaaccgggacaccaanatgcggcgaccgngggagccgcgttggctgcagccaacgccgacggcccacccctcccaaactccctagtaccgtacgaggaatcgaaccgacccggaccctacgaaaactctttaccgagtaggtacgttacctttttacccgaaccccgttaccgaaacggaacctaaaaccgtaaaacttacccgaaccgtacccccttaccgttaaccgttacccgaaacccttaaacgttacccgttaccggtcccttaacccgaccgtcccgtacggaacggacggacggccgtacgtaccgttactaccgttcgaccgtccgacgtccggtacggaccctaccgaccgccgtcgtcgtcgtccgttcggtcgtttcgggacggtacggtaccgaaccggtcgtaccggtaccgtaccgttcgggaccgaaccggtacccggtaacggtcccgtacccggtccccgtccggtaccttaccccgg

SEQ ID NO: 432594 - DNA, 627 bp, Homo sapiens
  misc_feature: GZ8MTXP02H9XC1.19.85.H08.1.454.CMB.2.raw
  modified_base (257)..(257): a, c, t, g, unknown or other
  modified_base (261)..(261): a, c, t, g, unknown or other
tcagtactctcgtgcacgaccggtgctcgatttagtatcactcagtcgcgggctccaaacagagcttcagcaagcatagtgggaatctgcaccatgccctgggctctgctcctcctgacctcctcactcactctgcagtgtcagtggtccaggcaggactgactcacgccaccctcgggtcggtccgggggcctgggacacgggccgccacagtcacctgacaccgggaacaccaacaatgtcggcgaccgaggganccgntggctgcagcaacgccaggccaccctccaaactcctgtcgtacagatcgacaaccggcctacaaactattacagacgacgacttttccacctcaggtaaccaaactaaactaccaacgacccttctactacgaacctacttaacctcggtacctcccgacgtaccctacgtaaccgacggacggtacctacgtacctacgtaactcgtacctacgacgcccgtagggacccaccgaacgccctacgccgttcgtccgttcggtaccgtttcgggaccggttacgggacctaacggtccgtacgtaccgtccgtacgggtaaccgacggaccgtaacggccgtacccggtccccgttcggtaccccg

SEQ ID NO: 432595 - DNA, 618 bp, Homo sapiens
  misc_feature: GZ8MTXP02HWI93.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtcgtccgggggcctgggaccaggccgccacagtcacctgcaccgggaacaccaacaatgtcggcgaccgagggacgccgcgtggctgcagcaacgccgacgggccccacccctcccaaacctcctcgtacgtacaggactcggaccaacccggccctacaaacattacgagagtacgtattttaccacctaccgagaaccaacaactacaacgccctctactcgaacctacttacgtcggtcctaccacgcctcgaccgtacgacggctagactacgtactgctctacgccgtcgggaccacccgacgccgtcgcctgtcgttcgggttccgtttcggggcgggtacgggaccgacggtaccgtccggtaccgtccggtacggggtccgaccggtaccccgtaacgggtccctacccggtcccccgttaccgggtcccg

SEQ ID NO: 432596 - DNA, 585 bp, Homo sapiens
  misc_feature: GZ8MTXP02F7PV1.19.85.H08.1.454.CMB.2.raw
  modified_base (279)..(279): a, c, t, g, unknown or other
  modified_base (426)..(426): a, c, t, g, unknown or other
  modified_base (451)..(451): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtggaggtggagttggtggagtcgtgggggagcgttggttcagccgtgggacgggtccctgagagtctcctgcacagcctctggattccaccttnaagtaactatgagagtggactggactcccgcgaggcctaccgaagggaagggctaggagtggattgacctatgtcacgtagtgaggcaagtccacgtcctacggcgtactctggtcggccggggtaccgttacatccaccagacganaagcgaacaaagagacgtcttcttnagactaagttcggacgcctaggagagtacgaaagcgaacggtacttaagtttacttacgtggtagtaaggacggaggggtaacgggggctacggtggtcggtacgggtcggtacgtagtttcgtttaggttagg

SEQ ID NO: 432597 - DNA, 576 bp, Homo sapiens
  misc_feature: GZ8MTXP02HZ88R.19.85.H08.1.454.CMB.2.raw
  modified_base (290)..(290): a, c, t, g, unknown or other
  modified_base (300)..(300): a, c, t, g, unknown or other
  modified_base (310)..(310): a, c, t, g, unknown or other
  modified_base (324)..(324): a, c, t, g, unknown or other
  modified_base (356)..(356): a, c, t, g, unknown or other
  modified_base (359)..(359): a, c, t, g, unknown or other
  modified_base (367)..(367): a, c, t, g, unknown or other
  modified_base (380)..(380): a, c, t, g, unknown or other
  modified_base (411)..(411): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctctcactcactctgcagtgtcagtggtccaggcaggactgactcagcccaccgtcggtcggtccgggggcctggggacaggccgccacagtcacctgccgaaccgggaacaccaacaagtcggtcggcgaccgagggacgccgcttggctgcagcaacgcaggccaccnccaaactccngtcacaggancgacacgccacaantacagagtagtactttcactcagacaacaaancanctctctanacattactcgtcncagctagacgtagagtctacgactactacgngtctacgacgaccgtacgggacccaaaccgcgtcccgtacgccgttcgtcgtttcgggtacgtttccggggacggacggttaaccgaacgtcgtaccggtaccgtccggttacggaccgaacggtacccgaacggtcctcccggcccccgttggtacccgtcccg

SEQ ID NO: 432598 - DNA, 680 bp, Homo sapiens
  misc_feature: GZ8MTXP02IBQ8V.19.85.H08.1.454.CMB.2.raw
  modified_base (232)..(232): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctctcactcactctgcagtgtcagtggtccaggcaggactgactcagccaccctcggtgtccgggggcctgggacaggccgcacagtcacctgcaccgggaacaccaacaangtcggcgaccgagggacgccgcttggctgcagccaacgccagggccccaccctacccaaactcccgtgtccgtacaggaactcgaaccaaacccggccctacaaaactactttacaagagagtaccttttcaacctcagactaacaaaatcacgtcctcctactacgacctaattaccgtcgttacctaccctacgtaccgttacggaaccgtacgtacggtcgtacgaaccgtacgtactacgtacctacgacgtaccgtacgggaccaccgacgtaccctcggtctcggtccgtttacgggtccgttttccggggaccgggtaaccggggtaccgtaaacggtccggttaccggtacccggttcccggttacgggtaccgtaacccgggtacccgtaaacgggccccgtacccggtccccccggtacggttccccgttaaccccgg

SEQ ID NO: 432599 - DNA, 764 bp, Homo sapiens
  misc_feature: GZ8MTXP02GGXS9.19.85.H08.1.454.CMB.2.raw
  modified_base (266)..(266): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctctcactcactctgcagtgtcagtggtccaggcaggactgactcgagcccacccgtcgggtcggtccgggggcctggggacacggccgccacagtcaccgtgacgaccggaacaccaacagtcgtacggcgacgaggacgccgntggctgcagcacgccgacggacccacccctacccaaactccgttagtaccgtaacgacggtaacgtacggaaccgaaccccgggaccctaaccgtaaaacctaacgtttacccgaaaggtacggtaaccggtttacctttttacccgtaacccttacccggtaaacgggaaccctaaaacgtaaacctacccgtaaaccggtaccccgttaccttaccgtaacgtaacccttaactttaaaccgtcggttaacccttcccgaacgcccgttacggaaccgaccggtacggtaccgtacgaaccttaaccggttacttcggacctacgaaccgttccgacgggaaccacccggacgtcccgtcgtccgttcggtccgtttacggtccgtttacggggaccgggtaaacggtaccgaaacggtcgttaccggtacccggtccgtacgggtccgaaccggacccgaaggtccccgtacggtcccccgtacggtttaccccg

SEQ ID NO: 432600 - DNA, 620 bp, Homo sapiens
  misc_feature: GZ8MTXP02ITR3G.19.85.H08.1.454.CMB.2.raw
  modified_base (257)..(257): a, c, t, g, unknown or other
  modified_base (278)..(278): a, c, t, g, unknown or other
  modified_base (419)..(419): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggagcttggttcagcctgggacgggtccctgagagtctcctgcacncgcctctggacttcacccttnaagttaactatgagatggactggatcccgcgaggcctccgaagggaaggggctggaggtggtattcgaccttagtgtacacgtaggtgagggcgaagtccacgtccgacggcgactcgtggcggccgggggtcccgttacntctcagacgacaagtcgacgaagaacgactcttcttctgacttaagttccgggacgtcctggacgaggtacgaaacgactacggtatttaactttaacttacgttggtttacggagggtaaagggacgggggtacgggggtacgtacggtgggtcggttaggggttccggggtcgttagttttccggttttagtttacggg

SEQ ID NO: 432601 - DNA, 618 bp, Homo sapiens
  misc_feature: GZ8MTXP02ILCJ1.19.85.H08.1.454.CMB.2.raw
  modified_base (348)..(348): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccgggggcctgggacacggcccgccacagtccacctcgaccgaaccgggaaccaaccaacaagtcggtcggaccgaccgaggggacgccgtcgttggctgcagcaacgcgacggccaccctacccaactcctgtcgacaggatcgaacaccgacctacaactnttcagagtacttactttaccacctacgagacaacaaactcacgcctctactacgtactattacgtcgtcaccgacgacctacggaacgacgacggtctacgtaccgtactacgtacgcctacgacgtaccgtacggaccaccgacgacctcgtactcgtcgttacggtcgtttcgggacggtacggaccgacgtcgaccggtccgtaccgtcggaccgaaccggacccggacggtcccgtacccggtccccgtaccggtaccgttacccg

SEQ ID NO: 432602 - DNA, 569 bp, Homo sapiens
  misc_feature: GZ8MTXP02JBBQY.19.85.H08.1.454.CMB.2.raw
  modified_base (312)..(312): a, c, t, g, unknown or other
  modified_base (378)..(378): a, c, t, g, unknown or other
  modified_base (524)..(524): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtcccgggggcctggggacaggcccgccacagtccacctgccgaaccgggaacaaccaacaagtcggtacggccgaaccgaggggacgccgcttggctgcagcaacgccacggccacccctcccaaactccngtcgacaggaatcgacaaccggccctacaaactatttcagagatactttcacctcagacaacaaancagcctctactacgacctattactcgtctcacgactgacgacgaggctagactactactgctacacgtccgtacgggaccaccgacgcccgtcgctcgtccttggtcgtttccggacggacggaccacgtccgtacgccgtaccgnggtccaacggcccgacggcctccggccccgttcggtacctacccg

SEQ ID NO: 432603 - DNA, 652 bp, Homo sapiens
  misc_feature: GZ8MTXP02GMPGM.19.85.H08.1.454.CMB.2.raw
  modified_base (256)..(256): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacccgtcggtcgtccgggggcctgggaccagggccgccacagtcacctgcaccgggaacaccaacaatgtcggcgaccgaggganccgcttggctgcagcaacgccgagggcccacccgtccccaaactcctgtcgtacaggaatcgaccaacccggccctacgaaacatttacagtagacgtacttttaccacctaccacggaacaacaaacgtacacgaccctctctacgacctattactcggtactaccgagtcctacgacgaccgaggccgtacgtaacctactaaacctcgtaccgttacgactacccggtacggggacccacccgaacgggtcctccgtccgttcggtccgtttcggtccgttttacgggaccgggtacgggaaacccacggtccgtacgtaacccggttccggtacgggttccgaaccggtacccgttaacggcccgtaccggtccccccgtcgggttaacccg

SEQ ID NO: 432604 - DNA, 644 bp, Homo sapiens
  misc_feature: GZ8MTXP02JS87P.19.85.H08.1.454.CMB.2.raw
  modified_base (208)..(208): a, c, t, g, unknown or other
  modified_base (265)..(265): a, c, t, g, unknown or other
  modified_base (329)..(329): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccacccgtcggtcggtccgggggcctgggacagggccnccacagtccaccgtcgcaccggaacaccaacaatcgtcggacgaccgagggagccgngtggctgcagcaacgccgacggcccaaccccgtacccaaactcctcggtacgtacgaggtaacncgaaaccgacccggccctacaaactattcaagacgtaacgtactttaccaaccgtccaaggaaccaataactaccgaacgtccctactacacgtaaacctacgttaaccgtcggtacctacccgacgcccttacggaccgacgacgtacgtacacgttacctacttcggacctacgcgacccgtacgggaaccacccgagcccgtcgctccggtcgttcgtcgtttcgggacggtaccggaaccgtacgccgtaccgaccggttccgtacggtccgaccggacccgtacggccgtacccgtcccgtcggtacccg

SEQ ID NO: 432605 - DNA, 649 bp, Homo sapiens
  misc_feature: GZ8MTXP02IUCKA.19.85.H08.1.454.CMB.2.raw
  modified_base (242)..(242): a, c, t, g, unknown or other
  modified_base (254)..(254): a, c, t, g, unknown or other
tcagtactctcgtgcacgaccggtgctcgatttagtatcactcagtcgcggggtctcagagaggtgccttagtcctggagtccaaggcacgtccacttggtgatcagtactgaacacagaggactcaccatggagttgggttgtgctgggttttcctgtcgctattttagcaggtgtccaatgtgaggtggagttggtggagtcgtgggggagtcttggttcagccgtgggaggtcctgagngtctcctgcacngcctcgtgacttccaccttcaagtaactatgagagtggactggactccgccgaggcctaccgaaggggaaggggtcgtagggagtggtattcgaccttatcgtacaccgtggtaggacgggacacgtcgaaccgtccgtaacggcggtacttcgtagggtcgggcccggggttaccggtttaccactccgtaccgagacgaacagtaccgaaccgaaaggaacgaccgtctttacttcgtagtaccgtaagttcgggacggtacctagaaggtacgacgaacgaccgacggtacttaatttagtacgtggtagtaagggacggaggggacgggggactcgggtcgggtacggttcgggggttcggtacggttcgtttacggtttacggtttaggg

SEQ ID NO: 432606 - DNA, 664 bp, Homo sapiens
  misc_feature: GZ8MTXP02IU80D.19.85.H08.1.454.CMB.2.raw
  modified_base (560)..(560): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggtcttggttcagccgtgggacggtcctgagagtctcctgcacacgcctctggattcaccttcaagtaactatgagatggactggactcccgcaggcctaccgaagggaaaggggcgtagggagtggatttcgccttagtcgtactaccgtaggtcggacggggacgtaaacggtccgtaaccgtcccgtaacggccggtacttccgtggtcgggtccgggggttacccgtttaccgacttcccgtaccgaaggaacgaacgaagtacgaaccgaaaggaacgacgtcttcttctcgacttaagtcgggaccggacctaggagtacgacgaaacggacgtaacgtntttaagtttactacgttggtagttaggagggtacggggacgggggactacggtgggtcggttacggggttcgggttacgtacgtttcggtttttagtttacggg

SEQ ID NO: 432607 - DNA, 511 bp, Homo sapiens
  misc_feature: GZ8MTXP02F6GBX.19.85.H08.1.454.CMB.2.raw
  modified_base (342)..(342): a, c, t, g, unknown or other
  modified_base (470)..(470): a, c, t, g, unknown or other
  modified_base (486)..(486): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactgatccgccaggctccaggaagggctggagtggattgcctatgtcactagngaggcgaagtcaacgtcctacgcggactcgtgtggccgggggccggtttaccatctccagagacaatgcaagaagacgctcttctgcaattgacgcctgagagtcgaagacaacgctattattatgtntgagagagggggcagngcgtggtcgggtcgtagtctttgtg

SEQ ID NO: 432608 - DNA, 617 bp, Homo sapiens
  misc_feature: GZ8MTXP02IHRB5.19.85.H08.1.454.CMB.2.raw
  modified_base (290)..(290): a, c, t, g, unknown or other
  modified_base (581)..(581): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttgggttgtgctgggttttcctgtcgctattttagcaggtgtccaatgtgaggtggagttggtggagtcgtgggggagtcttggttcagccgtggacgggtccctgagagtctcctgcacagcctcgtggtacttcaccttcaagtaactatganagtcggactggactcccgcgacgccgtaccgaagggaacggggcgtaggacgtggtattcgaccttatcgtacaccgttaggtggacgggacgtaagtccaccgtccgtacgcggtacctcgtcggtcgggccggggttacccgttacatcctaccgagtaacgactaatcgaacgaaagaacgacgtcttctttcagtactagttcgggacgtcctagacgagtacgaaacgacgacgttacttaagttttacgttagtggttagtaggaggaggggaacggggctaggnggtcggtcggttacggtgtacgtttcgttagtttgg

SEQ ID NO: 432609 - DNA, 574 bp, Homo sapiens
  misc_feature: GZ8MTXP02HVM7M.19.85.H08.1.454.CMB.2.raw
  modified_base (261)..(261): a, c, t, g, unknown or other
  modified_base (294)..(294): a, c, t, g, unknown or other
  modified_base (334)..(334): a, c, t, g, unknown or other
  modified_base (379)..(379): a, c, t, g, unknown or other
  modified_base (398)..(398): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacacgtcacctgcaccgggaacaccaacaatgtcggcgaccgaggagccgcttggcngcagcaaacgcacggccaccctcccaaactccngtcgacaggaatcgacaaccggccctacaaacattcaganagtactttctacctcaggacaaccaaaatcagaccctctccgtanacctattactagtctccanctcgacgacgacggctcgactactactacgtctacacgaccgtcgggaccaccgaacgcctcgcgtgtccgttggtacgttttcgggacggtacggacccgaaagccgtacgaccgtccgtcggtacgaacggaccccgaaacggcccgtaccgtcccccgtcggtccgtaacccg

SEQ ID NO: 432610 - DNA, 565 bp, Homo sapiens
  misc_feature: GZ8MTXP02H3NGD.19.85.H08.1.454.CMB.2.raw
  modified_base (321)..(321): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcacggacacaacatgtcgcgacagggagccgcttggctgcagcaacgccaggcccaaccctccccgaaactcctgtaccgtacaggaatcgaccaaccggcccctanaaactatttcagagagtactttcacctcagacaacgaaaatccagccctctactacgaacctaatttactcgtctaccacgcctgacgacgaggctacgactactactgcctacacgtccgtacggaccaccgacgcctcgcgtcgtcgttggtccgttttcggcggtacggaccgaacggtcgtacgtaccgtccgtagggtcaacggacccgaacggcctccggccccgtcggtacctcccg

SEQ ID NO: 432611 - DNA, 601 bp, Homo sapiens
  misc_feature: GZ8MTXP02FSHFU.19.85.H08.1.454.CMB.2.raw
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggaacaccaacatgtcggcgacagggagccgctggctgcagcaacgccagggcccacccgtcccaaactcctgtccgtacaggaactcgaaccaacccgggccctacaaaacctatttacgaagagacgttacttttaccacctaccaggaacctaaacaaactacacgtcctacctctacgacctattacctgtacctcacgcctagacgacgagctagaactactaactcgctacgacgcccgtaggggaaccacccgacgtcctccggctcgtcgtttcggttccgtttacgggcgggtacgggacctaacggccgtacgtacccgtccgtgggtaaccgacgtaccccgacggtcctccgacccccgtcggttaccc

SEQ ID NO: 432612 - DNA, 644 bp, Homo sapiens
  misc_feature: GZ8MTXP02IM80S.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggtcgttggttcagccgtgggacggtccctgagagtctcctgcacacgcctctggtacttccacccttcaagtaactatgaagtagtggacgtggactccccgaccgacggccgtaccggaaggggaaacggggcgtagggtaggtggtattcgaccttagtcgtacgtacgtagtaggagggacgtaacgtccgtacgtccgtacggcgtaccgtcgtggtcgggccggggtcccgttaccagtcctacgagacgacaacgtcgaacaagaacgactcttcttctgactagtcggacgcgtagacgacgtacgaacgaccgtacgtactttaacgtttactacgttggtcgtagggacggtacggggacgggggctacgggtcggtcggttcggggtcgggtacgttaggtttcgttttaggttcgggg

SEQ ID NO: 432613 - DNA, 645 bp, Homo sapiens
  misc_feature: GZ8MTXP02IC4X6.19.85.H08.1.454.CMB.2.raw
  modified_base (258)..(258): a, c, t, g, unknown or other
  modified_base (359)..(359): a, c, t, g, unknown or other
  modified_base (464)..(464): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggtgtgctgggttttcctgtcgctattttagcaggtgtccaatgtgaggtggagttggtggagtcgtgggggaggcttggttcagcctggaggtccctgagagtctcctgcacagcctntggattcaccttcaagttaactatgagagtggactggactccgcaggctaccgaagggaaaggggcctagggagtggattcggcctagtcgtcaacgttgnggagggcgaagtccacgtcctacgcgtactcgtgcggccggggtcccgtttacattcctaccgaagacgaacaagtcgacgaaagtaacgacgtcttactttcgngtacctagttacgggaccggtacgtaggacgtacggtaacgaaacggtaccgtaacggtaccttaaagttttaacgttaacgttggtacggttaggaaacgggaggggaacgggggtcgtaacggtcggggtaccggttagggggtcccggggttacgtaagtttccgttttaggttacgg

SEQ ID NO: 432614 - DNA, 732 bp, Homo sapiens
  misc_feature: GZ8MTXP02JRO45.19.85.H08.1.454.CMB.2.raw
  modified_base (329)..(329): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgcccacccgtcggtcggtccgggggcctgggaccaggcccgccacgacgtcaccgtgaccgaaccgggaacaccaacaagtcggtaccggacgaccgagggacgccgcgtggctgcagccaacgccgacggcccaccctacccaactcctgtccgtaacgnggaactcgaaccgaacccggtccctacaaacgtactttacgaagtacgtacgttaccctttttacccaaccgttaccgaaacggaacctaaaccgtaaaacttccgaacgtaccccttacttacgtaccgtaacctacgtttaccgtccggtaccttacccgacgtaccgtacggaccgacggtacggaccgtacgtacttacctaccgtacgtccgtaccgacggtaccgacgggaccaccgaccgtcccgttacggtcccgttggtccgtttacggtcggtttacgggacgggttaccggaacgtacgtccggttacggacccggttccggtacgggtacccgaaccggtacccggtaacggtccccgtacccggtcccccgttacggtaccctttccccg

SEQ ID NO: 432615 - DNA, 561 bp, Homo sapiens
  misc_feature: GZ8MTXP02IZS3Y.19.85.H08.1.454.CMB.2.raw
  modified_base (228)..(228): a, c, t, g, unknown or other
  modified_base (233)..(233): a, c, t, g, unknown or other
  modified_base (240)..(240): a, c, t, g, unknown or other
  modified_base (248)..(248): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcactgcacggacacaacaangtcgnacaggancgctggcngcagcaacgccagggcccaccctacccaaactcctgtcgtacagaatgacaaccggaccctcaaaacatttacagagagtacttttacacctaccaaggacaacaaaaaatccaagccctactctagaaccctattaactgtactccagcctacgacgacgaacggcttagaacctaactaacttggactcgacgcccgggaaccaaccaacgcctcgcgtcgcttggcttttcgggacggtacgggaaccgagacgtagaccgtcctcggtacacgccgaaacgggctcggaccccctcggtccaacttccg

SEQ ID NO: 432616 - DNA, 780 bp, Homo sapiens
  misc_feature: GZ8MTXP02JCJQQ.19.85.H08.1.454.CMB.2.raw
  modified_base (236)..(236): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccacccgtcggtggtccgggggcctgggacacgggccgccacagtcacctgcaccgggaacaccaanatgtcggcgacgaggagccgcttggctgcagcaacgccgacgggcccacccctacccaaactcctcgtaccgtacgaaggaatcgaaccgaaacccggcccctaacgaaaacctactttacgaaacggtaagtaccgttactttttacccgtaacccttaccgaacggtaaaccctaaaacctaaaacgttaccgaaacggtaccccttacctaacttaccggtaaaccctaactttaaccgttacggttacccttacccgtaacgtcccgttaacgggaacccgaaccgggtacgggtaccgttacggaaccttaaccttaaaccgtcgtaccgtaccgtacgtacccggttacggggaaacccacccgtaacggtacccgtccgtccgtacggttcccgtttcgggtcccgtttttaccgggggacccggggtacgggtaacccggtaaacggtccgtaccggtacccggttcccgtacggggtaacccgaccggtaccccggtacggtaccccgtaccggtccccccgttacggttccccg

SEQ ID NO: 432617 - DNA, 611 bp, Homo sapiens
  misc_feature: GZ8MTXP02ISBKB.19.85.H08.1.454.CMB.2.raw
  modified_base (262)..(262): a, c, t, g, unknown or other
  modified_base (420)..(420): a, c, t, g, unknown or other
  modified_base (425)..(425): a, c, t, g, unknown or other
  modified_base (463)..(463): a, c, t, g, unknown or other
  modified_base (559)..(559): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgcttgggtttttccttgtcgcttatttttagcaggtgtccaatgtgaggtggtagttggtggagtcgtgggggagtcttggttcagcctgggacggtccctgagagtctcctgcacngcctctggacttcaccttcaagtaactatgagatggactgactccgcgaggctaccgaagggaagggcgtaggagtggtattcgaccttagtcgtacaccgtaggtgagggcgaagtccacgtccgtcgacgactcgtgtcgggccgggtccttacgnttccncgagacgacatgaacccaagacacgtcttacgtttacncgactaagtcgggaaccgtcgtaggaagtaggtacggaataccgacgttcttaatttacgttagtggtaggtaggaacggagggggacggggtacncgggtcgggtggttcgggtacggggttcgtagttttcggtttaggtttacgg

SEQ ID NO: 432618 - DNA, 722 bp, Homo sapiens
  misc_feature: GZ8MTXP02HQFGG.19.85.H08.1.454.CMB.2.raw
  modified_base (265)..(265): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgacctcacgccacccgtcggtcggtccgggggcctgggacacggccgccacgagtccacctgaccgaaccgggaacaccaacaagtcgtcggcgacgagggacnccgcttggctgcagcaacgccacggcccacccgtacccaaactcctcgtaccgtaacacggtaactcggaaaccaacccggtacccctacgaaaactatttccgaagtacgtaacgttaccttttacctaaccccgttcgaaacggaaacctaaaacctaaaaactaccgaaaccgtaccccttaccgttacccgttacgtaaccccttaaagtttacccgtacggttaccctacccgtaacgtacccgttaccggaaaccggttacccggacggtaccgttacggaaccttaccgtaaccttcgacctacgtaccgtaccgtacgggaccaccgacgtcccgtcgtcgtcgtcgttcggtcgtttccgggacggacggtacacgtcgtaccggtaccgtccgtacggtaccaaccgaccgtaacggtcccgtcgtcccccgtacgttacctacccg

SEQ ID NO: 432619 - DNA, 584 bp, Homo sapiens
  misc_feature: GZ8MTXP02F1GED.19.85.H08.1.454.CMB.2.raw
  modified_base (249)..(249): a, c, t, g, unknown or other
  modified_base (334)..(334): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtccgggggcctgggacacggccgcacagtcacctgcaccggaacaccaacatgcgcgacaggagccgnttggctgcagcacgccaggcccacccgtaccaactcctgtcgacaggaatcgaccgaaccggccctacaaactatttccgagagntactttcctacctcaagacaacaaatcacgcctctactcgaactattaacgtcgtacctccaacgtcctagacgacgtacggctacgaacctactacgtacgcctcgacgtccgtacgggacccaaccgaccgtcccgtcgtcgtcggtgtttccgggtacgtttcggggaccggtacggaccgaaacgtccgtacgtccgtccgtcggaccgaacgacccgaggccgtaccggcccgtccgtacctccg

SEQ ID NO: 432620 - DNA, 701 bp, Homo sapiens
  misc_feature: GZ8MTXP02FM4ZZ.19.85.H08.1.454.CMB.2.raw
  modified_base (366)..(366): a, c, t, g, unknown or other
tcagtactctcgtgcacgaccggtgctcgatttagtatcactcagtcgcgggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttgggttcagccgtgggagggtccctgagagtctcctgcacacgtcctctggattcaccttcaagtaaactatgaagatggactggactccgccgaggctaccgaagggaaaggggcgtagggagtggattcgacctatgtcactagnggacgggcgaagtccacgtcccgtacgcggtactccgtgggtcggccgggggttacccgtttacgacttcccgtaccgaagacgaacaatcgacgaaagaacgacgcgtttacctttctagacgtaagttcgggacgggtacccgttagaacggtacggtacggtaaacggaccgtaaccgggtactttaaaagtttttaacgtttaaacggttggttagggttagggacgggtaacgggggtaacgggggggtaaccttacgggtgggggttaccggtttcgggggttaccgggggttacggtttaacgtttcggtttttaggtttaaccgggg

SEQ ID NO: 432621 - DNA, 642 bp, Homo sapiens
  misc_feature: GZ8MTXP02HPUJF.19.85.H08.1.454.CMB.2.raw
  modified_base (353)..(353): a, c, t, g, unknown or other
  modified_base (382)..(382): a, c, t, g, unknown or other
  modified_base (425)..(425): a, c, t, g, unknown or other
  modified_base (625)..(625): a, c, t, g, unknown or other
tcagtactctcgtgcacgaccggtgctcgatttagtatcactcagtcgcggggctccaaacagagcttcagcaagcatagtgggaatctgcaccatgccctgggctctagctcctcctgaccctcctcactcactctgcagtgtcagtggtccaggcaggactgactcacgcccacccgtcggtcggtccgggggcctggggaccacgggcccgaccacgagtccacctgaccgaaccgggaaccaaccaacaagtcggtccggacgaccgagggcgccgtcgttggctgcgacgacgaaccgccgacgggccccaccccgtacccaaacctccgtgtcgtaacgaggtaacncggaaccgaacccggtccctacgaaactntttaccgaggtacgtacctactttacaccctacgagaaccaanaactcacgtcctactacacgactacttacgtcgtacctcgacgtccgtagaccgacgtgtcctacgtacctacgtacgtacgtctaccgtacgtccggacgggaacccaccgcgtccgtcgtacgtcgtcgttcggtaccgtttcgggacggtacgacccgagtccgtcggccgttcgcggtccgaaccgcgtacgtccncccgtcccgtcggtccc

SEQ ID NO: 432622 - DNA, 582 bp, Homo sapiens
  misc_feature: GZ8MTXP02FHATM.19.85.H08.1.454.CMB.2.raw
  modified_base (533)..(533): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtcggtccgggggcctgggacacggccgccacagtccacctgcaaccgggaacaccaacaatcgtccggacgaccgagggacgccgcttggctgcagcaacgccgacggccccaccctaccaaactcctagtccgtacaggaatcgaccaaccggcccacaaactattacagagtagtactttcacctacagacaacaaaataccacgcctactcacgacctattactgtacctccacgtctgacgacgagctagtactactactcgctacacgccgtacgggaaccaccgacgcctcgctcgcgttcggtcgtttccgggacggtacggaccaacggtccgtacgtaccgtccgngggtaccaaacggtccgaacggccgtccggccccgtcggtacctacccg

SEQ ID NO: 432623 - DNA, 744 bp, Homo sapiens
  misc_feature: GZ8MTXP02GZ93B.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccacccgtcgggtcggtcccgggggcctggggaccacggcccgccacacggtccaccgtgaccgaaccgggaacaccaaacaagtcggccggcgaccgaggggacgccgtcgtggctgcacgccgacgccgacggtcccaccccgtaccaaacctccgtacggtaccgtaacgaacggtaactacggaaccccgtaacccggccccttaacgaaaacgttactttaccgaagtaacgtacgtttacccttttacccaacccgttaccgaaacggtaacctaaaacctaaaaactaccggtaaaccgttcccttaacccgtaccgtaaccgtaaaccttacgtttaacccgtcgttaccctaccgtacgtcccgtaacggaaccgacggtaccggctacgtaacctacgtactacggccttacgaccggtccgtaccgggactaacccgtccgccgtcgtcgtcgtccgttgggtccgtttcgggacggacggtaccaacggtccgtaccggtaccgtcgtaccggacgaaccggtacccgtacggtcccgtcccgtacccgtccggtactccccgg

SEQ ID NO: 432624 - DNA, 661 bp, Homo sapiens
  misc_feature: GZ8MTXP02JEJW4.19.85.H08.1.454.CMB.2.raw
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttcctgtcgctattttagcaggtgtccaatgtggaggtggagttggtggagtcgtgggggaggtcttggttcaggcctgggagggtccctggagtagtctcctgcacagccctgtggtacttccaccttcaagtaactatagagatggactggactcccgcgaggcctaccgaagggaaggggctgggagtggtattcgacctagtgtacacgtaggtaggacggacgtaagtcgacgtccgtacggcggtactcgtggtcgggtccgggtaccgttaccgcttcgtaccgagaacgacgtaagtcgaacgaagaacgacctcttacttcgtagacgttaggttcggaccggtcgtaggacggtacgtacggaacggtaccgacggttacttattttacgttacgtggttacggtaggtaacggggagggggacgggggtaccgtagggttcgggacgggttcggggttaccggggttacgttaggtttttcgtttaggtttacgggg

SEQ ID NO: 432625 - DNA, 561 bp, Homo sapiens
  misc_feature: GZ8MTXP02F6JJD.19.85.H08.1.454.CMB.2.raw
  modified_base (441)..(441): a, c, t, g, unknown or other
  modified_base (458)..(458): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggaacaccaacaatgtcggcgaccagggagccgcttggctgcagcaacgccagggcccacccctcccaaactcctgtccgtacaggaatgaccaacccggccctacgaaacatttcaagagacgtacttttcacctccaaggaccaacaaactcaagccctactctacgaccctattactggtcctccagcctgacgtacgacggctcgactactacgtcnctcacgcctacgggacnccacgcctcgtctcgtcttcggtcgttttcggacggtacggaccgaacgcgtacgtaccgtccgtcgggtcgacgcccgaacggcctccgccccgtcggtacc

SEQ ID NO: 432626 - DNA, 685 bp, Homo sapiens
  misc_feature: GZ8MTXP02JKRY7.19.85.H08.1.454.CMB.2.raw
tcagtactctcgtgcacgaccggtgctcgatttagtatcactcagtcgcggggtccaaacagagcttcagcaagcatagcgggaatctgcaccatgccctgggctctgctcctcctgaccctcctcactcactctgcagtgtcagtggtccaggcaggactgactcagccaccctcggtgtccgggggcctgggacaggccgccacagtcacctgcgaccgggaacaccaacaatgtcggcgaccgaggggacgccgcttggctgcagcaacgccacgggcccaccctcccaaactccgtgtaccgtacgacggaactcgaaccgaacccggccctacaaaacctatttaccagaagtacgtacttttaccacctaccgaaggtaaccaaactaaaactcaacgtaccctactactacgaacctattacctacgtacctacccgaacgtcctaggaccgacgacgctacgaacctaccgtactcgacttccgaacgtcccgtacgggaacccacccgtacgccctaccgcgttacgtcccggtttgggttcccgtttcccggggacgggtaccggggtaaacccgaaacgggtcccgtacgggtaccccgttcgtaccggggtaccaaccgggtaccccgacgggtaccccgtcccggtcccccgttaccgggtccttaaccccg

SEQ ID NO: 432627 - DNA, 684 bp, Homo sapiens
  misc_feature: GZ8MTXP02H0N4J.19.85.H08.1.454.CMB.2.raw
  modified_base (231)..(231): a, c, t, g, unknown or other
  modified_base (282)..(282): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctggggacaggccgcacagtcacctgcaccgggaacaccaanatgtcggcgaccgagggagccgcttggctgcagcaacgccacggccacccncccaactcctgtcgtacaggaatcgacaacccggccctacaaacatttcagtagagtacttttaccaccctacgaaggaccaacaaaaactccgacgtccctactctacgtacctaatttaccgtacggtcctaccacgtcccgttacgaaccggaacgacgggtcctacgtaaccttactaccgtcgtacccgttacacggtaccccggtaggggaacccaaccgtaccggtcccgtcgccgtcgttcggtttccgggttcgtttttcccggggaccggggtaacggggtaccgaaacggtccggtacgtaccccgggttccgttcggggttacccgaacggtacccccggaaacgggtccccgtcccggtccccccgtttaccgggtacccggttccccg

SEQ ID NO: 432628 - DNA, 645 bp, Homo sapiens
  misc_feature: GZ8MTXP02HYFG9.19.85.H08.1.454.CMB.2.raw
  modified_base (268)..(268): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagcccacccgtcgggtcggtccgggggtcctgggaccacgggccgccacagtcacctgaccgaccggaacacaaacaagtgtcggcgacgagggacgccgntggctgcagacaacgccgacggcccacccctacccaaacctcctcgtacgtacaggaatacgaaccacccggcctaacaaacctatttaccgaagtagtaccgtacttttaccacctacgaacgaacctaaacaactacaacgtaccctactacctacgaacctacttactcgtacctacacgccgtacgacgacgagtactacgtactactactcgactcacgcgtacgaccaccgacgccgtcgtcctgtaccgttcggttaccgtttaccgggacgggtaccggaaccgtacggaccgtaccggtacccgttccggtacgggtaaccgaccggacccgaaccggtcccgacccggtccccgtacggttaccccg

SEQ ID NO: 432629 - DNA, 592 bp, Homo sapiens
  misc_feature: GZ8MTXP02F9GLA.19.85.H08.1.454.CMB.2.raw
  modified_base (248)..(248): a, c, t, g, unknown or other
  modified_base (343)..(343): a, c, t, g, unknown or other
  modified_base (480)..(480): a, c, t, g, unknown or other
tcagtactctcgtgcacgaccggtgctcgattagtatcactcagtcgcggggctccaaacagagctcagcaagcatagtgggaatctgcaccatgccctgggctctgcctcctcctgaccctcctcactcactctgcagtgtcagtggtccaggcaggactgactcagccaccgtcgtgtccgtcctggacacggcccgccacagtccacctgccaccgggaacaccacatgtcggcgaccagggacnccgcttggctgcagcaacgccgacggcccaccccgtccccaaactcctgtccgtacaggaactcgaacctaaccccgggcccctacaaaaacctntttccaggtaacgaccgtactttttccacccgtaccgacggaccacacctacacggcctactcgtacacctattactcggtcctccacgaccctgaaccgacgaacggctcgaacctctcgttcgccttacacgccncggggaccaccgtcgccctcgctcgtcttcggtcgtttaacggcgacggacccaaggtcctcgacccgtccgtaggggccacggccctaggccctcgcccccttggtaaccc

SEQ ID NO: 432630 - DNA, 700 bp, Homo sapiens
  misc_feature: GZ8MTXP02HO4DY.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcatcactcactctgcagtgtcagtggtccaggcaggactgactcagccaccctcggtgtccgggggcctgggacagggccgccacagtccacctgcaccgggaacaccaacaatgtcggcgaccaggagccgcttggctgcagcacgccacggccaccccgtcccaaactcctacgtccgaacaggaatcgaaccgaacccgggaccctacaaaactactttacagaagaacgtacgtttacctaccttacccaacggtaaccaaacgtaaaactaacaacgtacccttacctacctacgtaaacctaactttaaaccgttacggtacccttacccgtaacgtacccgtacgtaaccggaacggacgggaccttacgtaaccgtacccttaaccgttacgtaccgtacctaacgtccccgtacggggacctaacccgacgtacccgtccgtccgtacgtcgttcggtccggttttacggacggggtaacgggaccgtaaacggaccgtacggaccgttcccggtcgggtaaccgtacggacccgtaacggccgtaccggcccccgttcggttaccccg

SEQ ID NO: 432631 - DNA, 733 bp, Homo sapiens
  misc_feature: GZ8MTXP02FXY2Q.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccctacccgtcgggtcgggtcccgggggccgtcggggacgacgggcccgccactacgtccaccgtcgaccgaaaccgggaaccaaccaaacaagtcggtaccgggaccggaacccgaggggacgcccgtcgttcggctgaccaggccaaccggccgaccgggacccccaacccctaccccaaaccttccgtacgtacgtacgaaggactaccggaaccgaaccccggtaccctaacaaaaccttcttacgaaggtaagtacgtaactttccctaaccacgaacgaacaaaaccaaacacgactacctctacctacgtaacctatttaccgtcgtacctaccgtacgtaccgtaggaaccgacgacggtaccgtacgtaaccttaccgtacgtacggtacctcgacgtccgggtaccggaaccaccgaacccgtcgtcgtccggtctccggtttcggtcgggtttccgggaacgggtacgggaaccgtacggtaccgtacggttacccgtcggtcggaccgtaaccggaccgtacggcctcccggccccgtacggtaccctccgg

SEQ ID NO: 432632 - DNA, 641 bp, Homo sapiens
  misc_feature: GZ8MTXP02I3EST.19.85.H08.1.454.CMB.2.raw
  modified_base (235)..(235): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccaccctcgggtcggtccgggggcctgggacaggcccgccacagtcacctgcaccggaacaccaanaatgcggcgaccgagggagccgcttggctgcagcaaacgccgaggcccacccctacccaaactcctagtcgtaacaggaactacgaaccaacccggaccctacaaactactttacgaacgtaagtagtacctttttaccaacccttaccgaaacggaaccaaaacctaaaaaactccgaactaccctaccttactacgaaccctaattaaccgtcggtcctacctacgacctacgaacgacgacggtactagtaacctacgtactagccttacgaacgttccgacgggaaccaccgacgccgttcgcttcgccgttggtccgtttacggacgggtacggaccgtaacgcgttacggacccgtcgtcggacaacggccgaacggccgtccgccccgtcggtctcccg

SEQ ID NO: 432633 - DNA, 526 bp, Homo sapiens
  misc_feature: GZ8MTXP02F3GDR.19.85.H08.1.454.CMB.2.raw
  modified_base (251)..(251): a, c, t, g, unknown or other
  modified_base (324)..(324): a, c, t, g, unknown or other
  modified_base (351)..(351): a, c, t, g, unknown or other
  modified_base (354)..(354): a, c, t, g, unknown or other
  modified_base (358)..(358): a, c, t, g, unknown or other
  modified_base (360)..(360): a, c, t, g, unknown or other
  modified_base (376)..(376): a, c, t, g, unknown or other
  modified_base (380)..(380): a, c, t, g, unknown or other
  modified_base (382)..(382): a, c, t, g, unknown or other
tcagtactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggancgcttggctgcagcaacgccagggccacctccaaactcctgtcgtacaggaatggacaaccggcctacaaacnttcagagacatttcacgtcagaccaanaanacancnctcacacatactgtcncacncncgacgacgacgcgtacgactactactcgctcacgcgtcgaccgaccacgctcgtcgtcgtcgtcgtcgttcggtcggacggaccgtacgacgtaccgtaccgtccgtcggtcgacgaccgacggcgtccgtccccgtccgtccg

SEQ ID NO: 432634 - DNA, 770 bp, Homo sapiens
  misc_feature: GZ8MTXP02F9E25.19.85.H08.1.454.CMB.2.raw
  modified_base (214)..(214): a, c, t, g, unknown or other
  modified_base (260)..(260): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccgggggcctggggacacgggcccgcacngtcaccgtgccgaacggacacaacatcgcgcgaccgagggacgcgngtgctgcagcaacgccgacggtcccacccctaccctaaacgtcctaggtaccgtaacgtacggggaactaccggaacccgaaaccccggggtcccctaacgaaaaccgttacgttttaaccggaagtaaacggtaccggtttaacccttttttaccccgaaaccccgttaaccggtaaaccgggaaaccctaaaaaccggtaaaaactacccggtaaaccggttaccccttaacgttacccgttaccgtaaaaccttacgttttaaacccgttccggggttaacctaccccgtacggacccgttaacggaacccggaaccggtaccggtacgtacgtaacttaaccgtaactcggttaccaccgtacgtacccggtacggaacccgtaccgaaccgtcccgtacgcgtcgtaccgttcggtcggtttacggacggtacggacctacggccgtacgtaccgtcggtcggtacgaaccgccgaacggtcgtacccgcccgtacgtccgtacc

SEQ ID NO: 432635 - DNA, 696 bp, Homo sapiens
  misc_feature: GZ8MTXP02JYMR2.19.85.H08.1.454.CMB.2.raw
  modified_base (275)..(275): a, c, t, g, unknown or other
tcagtactctcgtgcacgaccggtgctcgatttagtatcactcagtcgcggggctccaaacagagcttcagcaagcatagtgggaatctgcaccatgccctgggctctgcctcctcctgaccctcctcactcactctgcagtgtcagtggtccaggcaggactgactcacgccacccgtcggtcggtccggggcctgggacacggcccgccacacgtccaccgtgaccgaaccggaaccaaccaacaagtcgtccggacgaccgagggacgccgngttgctcgcagaccaccgccgaccggcccctacccctacccaaactccgtgaccgtaacgaggtaactcggaaccccgaacccgtccctaactaaaccgtagtttaccgaacggtaagtacttaccgttttacccaccctaccgaacggaacccaaagtaaacctaccaccgtaccttacctacgttacaaccttagttaccgtacggtaccctccgaacgttccacgaaccggacggacggtacctacggtaacccttacgtaaccgtcgcccgttacgacgtccccggtaagggaacccaccgtcgtacccggtcgtctcggtacgtttcggttaccgtttgggaaccggacgaccgtagtcgtaccgccggtccgtaggccgaccgaccgtacgcccgtaccgccccgttcgtacccg

SEQ ID NO: 432636 - DNA, 573 bp, Homo sapiens
  misc_feature: GZ8MTXP02FM1QU.19.85.H08.1.454.CMB.2.raw
  modified_base (410)..(410): a, c, t, g, unknown or other
  modified_base (445)..(445): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtcgtgggggaggcttggttcagcctgggagggtccctgagagtctcctgcacagcctcgtggattcacccttcaagtaaactatgacgatggactggatccgcaggctccgaggaaagggctggagtgattgcctatgtcactagtgagggcgaagtcaacgtccaacgcggactcgtgtgggccggggtccgtttaccacttccncctaagagacatgaccaaagacgacgcttcgttcngactagtggacggtaccgtggacgagtcggaagaccgacggtacttatttacgtacgtgttacgtaggacggagggacgggggcacggtggtcgtcgggtcgggtactacgtttcgtttgtttacggg

SEQ ID NO: 432637 - DNA, 614 bp, Homo sapiens
  misc_feature: GZ8MTXP02HQZ0E.19.85.H08.1.454.CMB.2.raw
  modified_base (311)..(311): a, c, t, g, unknown or other
  modified_base (464)..(464): a, c, t, g, unknown or other
  modified_base (471)..(471): a, c, t, g, unknown or other
tcagtactctcgtgcacgaccggtgctcgatttagtatcactcagtcgcggggtccaaacagagcttcagcaagcatagtgggaatctgcaccatgccctgggctctgctcctcctcgaccctcctcactcactctgcagtgtcagtggtccaggcaggactgactcacgccacccgtcgggtcggtccgggggcctgggaccgacggcccgccacacgtccaccgtgaccgaaccggaacaaccaacagtcggaccggacgaccgacggacgccgcgttgctcgcagcacgcgacggccacccaccaacnccgtcgtcgacgaagactgaccgaccggaccacaaactctacagatagttaccttccactccaaaggacaactaaaacgtcacgtacctactctacgtactattcgtacgttcacccgacgtaccgcgacggacgtacggctacgtactaacncggtacncgtacacgtccggttgaaccgtccacgtccgtcgccttggcgttcgtttacggtacggtcggtacggacgtaacgtcggtccggtacgccgttaacggccgtaaccgaccggtacgtccgtccgacccgttcggcctttcccg

SEQ ID NO: 432638 - DNA, 700 bp, Homo sapiens
  misc_feature: GZ8MTXP02HAMTK.19.85.H08.1.454.CMB.2.raw
  modified_base (200)..(200): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttgggtgtgcttgggttttcctgtcgctattttagctaggtgtccaatgtggaggtggagttggnggagtcgtgggggagcgttggttcagccgtgggacggtcctgagacgtctcctgcacagcctgtggacttccaccttcaagtaactagtgagatggacctggactcccgcgaggtcctaccgaaggggaaacggggtctagggaagtggtattcgaccttatcgtcaccgttagtggaacgggacgtaagtccgacgttacccgtacgggtcggaaccttcggtcggtcggggcccgggggtttacccggtttaaccacgttacccgtacccgaagacgaaactaagcgaaccgaaaagaacgggacctctttaccttacgtgaccgttaagtcgggtaccggtacctagggacgaacgtacgaaacgtaacgccggttactttaagtttaacgtagttagtagggtacggtaagggtacgggggaaacgggggtctaacggtccgggtaggtttccggggtacggggttactacgttttaccggtttggtttaacgggg

SEQ ID NO: 432639 - DNA, 632 bp, Homo sapiens
  misc_feature: GZ8MTXP02JBYAH.19.85.H08.1.454.CMB.2.raw
  modified_base (255)..(255): a, c, t, g, unknown or other
  modified_base (259)..(259): a, c, t, g, unknown or other
  modified_base (269)..(269): a, c, t, g, unknown or other
  modified_base (275)..(275): a, c, t, g, unknown or other
  modified_base (278)..(278): a, c, t, g, unknown or other
  modified_base (285)..(285): a, c, t, g, unknown or other
  modified_base (315)..(315): a, c, t, g, unknown or other
tcagtactctcgtgcacgaccggtgctcgatttagtatcactcagtcgcggggtctcagagaggtgccttagtcctggagtccaaggcacttccacttggtgatcagtactgaacacagaggactcaccatggagttggggttgtgcttgggttttccttgtcgctatttttagcaggtgtccaatgtgaggtggagttggtggagtcgtgggggagcttggttcagcctgggaggtcctgagagtctctgcacngctntgattcactnagtatnganatggacnggatccgcgacggctaccgaggaacgggcnggagtgattcgcctatcgtcagtagtggaggtctaagtcaccggtcacgcggtacttcgtgggtcgggccggggttcccgtttacgacttaccgtccgagtaacgaacgaactacggacccgaaaggtaacgaccgtcgtttctttcgagacgttaaggttcgggaccggtaccgtagaccggtaggaccggaaagaccgacggttacttagttttaacttacgttggtcggttacggagggtaccgggggaagggggtccaacggttcgggtaggtcgggtttacggggtaccgttcgtttcgttttaggttcggg

SEQ ID NO: 432640 - DNA, 805 bp, Homo sapiens
  misc_feature: GZ8MTXP02FTI1T.19.85.H08.1.454.CMB.2.raw
tcagtactctcgtgcacgaccggtgctcgatttagtatcactcagtcgcggggtccaaacagagcttcagcaagcatagtgggaatctgcaccatgccctgggctctgctccctcctgaccctcctcactcactctgcagtgtcagtggtccaggcaggactgactcacgccctacccgtcgggtcgggtcccgggggccgtagggaccgacggcccgccacgacgtccaccgtcggaccgaacccgggaaccaaccgaaactaagtcggtccggaccgaccgaggggacgccgtcgttggctcgcgacgaccgaaccggcccgaccgggaccccctaacccccgtacccctaaacccgttccccgtacggtaccggttaaccgaaggtaaactaccggaaccccgaaccccggtacccctaacctaaaccgttactttaccgaaggtaaccccccgtagttaccctttttacccacccgtaccgaacgtaaccaaaacctaaaactaccaccgtccctacgttacctacgtaaccttactttaccgtacgtaccttacccgacgtccgtacgaccgacgtacggtacgtacgtacctactacgtacgtccgtaccgaccggtaccgtaccgggaacccaaccgtaccgtcccgtaccgtccgttcggttccggttcggttccgggtttacgggacgggtaccgggaccgtaacggtccgtaccggtacccggttccggtcggttaaccgaaccggtacccgtaccggtcccgtccccggtcccggtaccggttaccgttccccg

SEQ ID NO: 432641 - DNA, 396 bp, Homo sapiens
  misc_feature: GZ8MTXP01ENCH4.3.42.D09.1.454.CMB.2.raw
  modified_base (302)..(302): a, c, t, g, unknown or other
  modified_base (308)..(308): a, c, t, g, unknown or other
  modified_base (366)..(366): a, c, t, g, unknown or other
  modified_base (392)..(396): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcgtctcccctgcacctcnccaagngcacctctggggcacagcgccctggctgcctggtcaaggactacttccgagtgcgtcnctgagcggctggcaaaggcgcatagnnnnn

SEQ ID NO: 432642 - DNA, 395 bp, Homo sapiens
  misc_feature: GZ8MTXP01DX8PS.3.42.D09.1.454.CMB.2.raw
  modified_base (300)..(300): a, c, t, g, unknown or other
  modified_base (392)..(395): a, c, t, g, unknown or other
tcagagacgcactccacgaccggtgctcgatttagacacatacgcagggaagggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacggccgtgtaacgttggactactggggccagggaacctggtcaccgtctcctcagcctcaccaagggcccatcgtctcccctgcaccctccnccaagagcacctctggggcacagcggccctgggctgcctggtcaaggctacttccgagtgcgtctctgagcgggctggcaaaggcgcatagnnnn

SEQ ID NO: 432643 - DNA, 404 bp, Homo sapiens
  misc_feature: GZ8MTXP01EYSR4.3.42.D09.1.454.CMB.2.raw
  modified_base (401)..(404): a, c, t, g, unknown or other
tcagagacgcactccacgaccggtgctcgatttagacacatacgcagggaaagggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctcaccaagggcccatcggtctccccctggcaccctcctccaagagcacctctgggggcacagcggccctgggctgcctggtcaaggactacttccgagtgcgtctctgagcgggctggcaaagggcgcatagnnnn

SEQ ID NO: 432644 - DNA, 398 bp, Homo sapiens
  misc_feature: GZ8MTXP01BNRK7.3.42.D09.1.454.CMB.2.raw
  modified_base (387)..(387): a, c, t, g, unknown or other
  modified_base (391)..(398): a, c, t, g, unknown or other
tcagagacgcactccacgaccggtgctcgatttagacacatacgcagggaaaggggctggagtggattgggagtttctattatggtgggggaacctactaaaacccgtccctcaagagtcgagtcaccatatccttagacacgtccaagaaccaattctccctgaaactgaactctatgaccgccgcagacacggctgtttattattgtacggccgtgtaacgttggactactggggccagggaaccgtggtcaccgtctcctcagcctcaccaaggcccatcggtctcccctgcacctctcagagcacctctggggcacagcggccctgggctgcctggtcaaggactacttccgagtgcgtctctgagcgggctggcaaggcgcntagnnnnnnnn

SEQ ID NO: 432645 - DNA, 408 bp, Homo sapiens
  misc_feature: GZ8MTXP01B1ZNX.3.42.D09.1.454.CMB.2.raw
  modified_base (404)..(408): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttatattgtacgggccgtgtaacgttggactactggggccagggaaccgtggtcaccgtctcctcagcctccaccaagggcccatccggtcttccccctggcaccctcctccaagagcacctctgggggcacagcggccctgggctgcctggtcaaggactacttccgagtgcgtctctgagcgggctggcaaagggcgcatagnnnnn

SEQ ID NO: 432646 - DNA, 400 bp, Homo sapiens
  misc_feature: GZ8MTXP01B4EF8.3.42.D09.1.454.CMB.2.raw
  modified_base (380)..(380): a, c, t, g, unknown or other
  modified_base (392)..(392): a, c, t, g, unknown or other
  modified_base (396)..(400): a, c, t, g, unknown or other
tcagagacgcactccacgaccggtgctcgatttagacacatacgcagggaaggggctggagtggattgggagtttctattatggtgggggaacctactaaaacccgtccctcaagagtcgagtcaccatatccttagacacgtccaagaaccaattctccctgaaactgaactctatgaccgccgcagacacggctgtttatattgtacggccgtgtaacgttggactactggggccagggaaccgtggtcaccgtctcctcagcctccacaagggcccatcggtctcccctggcaccctcctcaagacgcacctctggggcacagcggccctgggctgcctggtcaaggactacttccgagtgcgtctctgacgcgggntggcaaggcgcntagnnnnn

SEQ ID NO: 432647 - DNA, 402 bp, Homo sapiens
  misc_feature: GZ8MTXP01BMFAY.3.42.D09.1.454.CMB.2.raw
  modified_base (304)..(304): a, c, t, g, unknown or other
  modified_base (310)..(310): a, c, t, g, unknown or other
  modified_base (397)..(402): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcgtctcccctggcaccctcnccaagngcactctggggcacagcggccctgggctgcctggtcaaggactacttccgagtgcgtctctgagcgggctggcaaagggcgcatagnnnnnn

SEQ ID NO: 432648 - DNA, 403 bp, Homo sapiens
  misc_feature: GZ8MTXP01AQ9N5.3.42.D09.1.454.CMB.2.raw
  modified_base (304)..(304): a, c, t, g, unknown or other
  modified_base (398)..(403): a, c, t, g, unknown or other
tcagagacgcactccacgaccggtgctcgatttagacacatacgcagggaagggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacggcctgtaacgttggactactggggccagggaaccgtggtcaccgtctcctcagcctccaccaagggcccatcggtctccccctggcaccctccnccaagagcacctctgggggcacagcggccctgggctgcctggtcaggactacttccgagtgcgtctctgagcgggctggcaaagggcgcatagnnnnnn

SEQ ID NO: 432649 - DNA, 406 bp, Homo sapiens
  misc_feature: GZ8MTXP01CKS0O.3.42.D09.1.454.CMB.2.raw
  modified_base (403)..(406): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactgggggccagggaaccgtggtcaccgtctcctcagcctccaccagggcccatcgtcttccccctggcaccctcctccaagagcacctctgggggcacagcggcccctgggctgcctggtcaggactactccgagtgcgtctctcgagcgggctggcaaagggcgcatagnnnn

SEQ ID NO: 432650 - DNA, 398 bp, Homo sapiens
  misc_feature: GZ8MTXP01EJ7J9.3.42.D09.1.454.CMB.2.raw
  modified_base (291)..(291): a, c, t, g, unknown or other
  modified_base (299)..(299): a, c, t, g, unknown or other
  modified_base (311)..(311): a, c, t, g, unknown or other
  modified_base (389)..(389): a, c, t, g, unknown or other
  modified_base (394)..(398): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaacctggtcaccgtctcctcagcctcacaagggcccatcgctccccngcacctcncaagagcactcnggggcacagcggccctgggctgcctggtcaaaggactaacttccgagtgcgtctctcgagcgggctggcaaaaggcgnatagnnnnn

SEQ ID NO: 432651 - DNA, 406 bp, Homo sapiens
  misc_feature: GZ8MTXP01EPPT7.3.42.D09.1.454.CMB.2.raw
  modified_base (307)..(307): a, c, t, g, unknown or other
  modified_base (402)..(406): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactacgtggggccagggaaccgtggtcaccgtctcctcagcctccaccaagggccctatcgtctcccctggcaccctcnccaagagcacctctggggcacagcggccctggctgcctggtcaaggactacttccgagtcgcgtctctcgagcgggctggcaaagggcgcatagnnnnn

SEQ ID NO: 432652 - DNA, 401 bp, Homo sapiens
  misc_feature: GZ8MTXP02FMHV7.3.42.D09.1.454.CMB.2.raw
  modified_base (398)..(401): a, c, t, g, unknown or other
tcagagacgcactccacgaccggtgctcgatttagacacatacgcagggaagggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttcccctggcaccctcctccaagagcacctctggggcacagcggccctgggctgcctggtcaaggactacttccgagtgcgtctctgagcgggctggcaaggcgcatagnnnn

SEQ ID NO: 432653 - DNA, 401 bp, Homo sapiens
  misc_feature: GZ8MTXP02F6PPX.3.42.D09.1.454.CMB.2.raw
  modified_base (399)..(401): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaaggcccatcggtcttccccctggcaccctcctccaagagcacctctggggcacagcggcctgggctgcctggtcaaggactacttccgagtgcgtctctgagcgggctggcaaggcgcatagnnn

SEQ ID NO: 432654 - DNA, 401 bp, Homo sapiens
  misc_feature: GZ8MTXP02JKATF.3.42.D09.1.454.CMB.2.raw
  modified_base (397)..(401): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaaggcccatcggtctcccctggcaccctcctccaagagcacctctggggcacagcggcctgggctgcctggtcaaggactacttccgagtgcgtctctgagcgggctggcaaggcgcatagnnnnn

SEQ ID NO: 432655 - DNA, 405 bp, Homo sapiens
  misc_feature: GZ8MTXP02IPG29.3.42.D09.1.454.CMB.2.raw
  modified_base (398)..(405): a, c, t, g, unknown or other
tcagagacgcactccacgaccggtgctcgatttagacacatacgcagggaaaggggctggagtggattgggagtttctattatgggtgggggaacctactacaacccgtccctcaagagtcgagtcaccatatccttagacacgtccaagaaccaattctccctgaaactgaactctatgacccgccgcagacacggctgtttattattgtacgggccgtgtaacgttggactactggggccagggaaccgtggtcaccgtctcctcagcctccacaggcccatcgtctcccctgcaccctctccaagagcacctctggggcacagcggccctgggctgccctggtcaaggactacgttccgagtgcgtctctgagcgggctggcaaggcgcgatagnnnnnnnn

SEQ ID NO: 432656 - DNA, 405 bp, Homo sapiens
  misc_feature: GZ8MTXP02GCMHR.3.42.D09.1.454.CMB.2.raw
  modified_base (401)..(405): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgttattattgtacgggccgtgtaacgttggactactggggccagggaaccgtggtcaccgtctcctcagcctccaccaagggcccatcggtcttccccctggcaccctcctccaagagcacctctgggggcacagcggcccctgggctgccctggtcaaggctacttccgagtgcgtctctgagcgggctggcaaggcgcatagnnnnn

SEQ ID NO: 432657 - DNA, 405 bp, Homo sapiens
  misc_feature: GZ8MTXP02FTFDI.3.42.D09.1.454.CMB.2.raw
  modified_base (400)..(405): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnn

SEQ ID NO: 432658 - DNA, 396 bp, Homo sapiens
  misc_feature: GZ8MTXP02I9DLD.3.42.D09.1.454.CMB.2.raw
  modified_base (307)..(307): a, c, t, g, unknown or other
  modified_base (387)..(387): a, c, t, g, unknown or other
  modified_base (389)..(389): a, c, t, g, unknown or other
  modified_base (392)..(396): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccacaaggcccatcggtctcccctgcaccctctccaangcacctctggggcacagcggcctgggctgcctggtcaaggactacttccgagtgcgtctctgagcgggctggcaaggcgnanagnnnnn

SEQ ID NO: 432659 - DNA, 399 bp, Homo sapiens
  misc_feature: GZ8MTXP02IMXYT.3.42.D09.1.454.CMB.2.raw
  modified_base (311)..(311): a, c, t, g, unknown or other
  modified_base (395)..(399): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccacaagggcccatcggtcttcccctggcaccctcctccaanagcactctggggcacagcgcctgggctgcctggtcaaggactacttccgagtgcgtctctgagcgggctggcaaggcgcatagnnnnn

SEQ ID NO: 432660 - DNA, 402 bp, Homo sapiens
  misc_feature: GZ8MTXP02GH4UI.3.42.D09.1.454.CMB.2.raw
  modified_base (396)..(396): a, c, t, g, unknown or other
  modified_base (400)..(402): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgcctcctcagcctccaccaagggcccatcggtcttccccctggcaccctcctccaagagcacctctgggggcacagcggccctgggctgcctggtcaaggactacttccggtgcgtctctgagcgggctggcaaggcgcntagnnn

SEQ ID NO: 432661 - DNA, 411 bp, Homo sapiens
  misc_feature: GZ8MTXP02G0G94.3.42.D09.1.454.CMB.2.raw
  modified_base (404)..(411): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatccggtcttccccctggcacccctcctccaagagcacctcgtggggcacagccggcctgggctgcctggtcaaggcctacttccgagtgcgtctctgagcgggctggcaaggcgcatagnnnnnnnn

SEQ ID NO: 432662 - DNA, 406 bp, Homo sapiens
  misc_feature: GZ8MTXP02GR3X0.3.42.D09.1.454.CMB.2.raw
  modified_base (402)..(406): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggctacttccgagtgcgtctctgagcgggctgggcaaggcgcatagnnnnn

SEQ ID NO: 432663 - DNA, 387 bp, Homo sapiens
  misc_feature: GZ8MTXP02HNJKS.3.42.D09.1.454.CMB.2.raw
  modified_base (298)..(298): a, c, t, g, unknown or other
  modified_base (377)..(377): a, c, t, g, unknown or other
  modified_base (383)..(387): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctcacaggcccatcgtctccctgcacctcncagagcactctggggcacagcgcctggctgcctggtcaaggctacgttccgagtgcgtctctgagcggctggcaaggcncatagnnnnn

SEQ ID NO: 432664 - DNA, 399 bp, Homo sapiens
  misc_feature: GZ8MTXP02HE5NV.3.42.D09.1.454.CMB.2.raw
  modified_base (397)..(399): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttatattgtacggccgtgtaacgttggactactggggccagggaaccgtggtcaccgtctcctcagcctccaccaaggcccatcgtcttcccctggcaccctcctccaagagcacctctggggcacagcggccctgggctgcctggtcaaggactacttccgagtgcgtctctcgagcgggctggcaaggcgcatagnnn

SEQ ID NO: 432665 - DNA, 407 bp, Homo sapiens
  misc_feature: GZ8MTXP02FMO44.3.42.D09.1.454.CMB.2.raw
  modified_base (264)..(264): a, c, t, g, unknown or other
  modified_base (401)..(407): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctnagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnn

SEQ ID NO: 432666 - DNA, 404 bp, Homo sapiens
  misc_feature: GZ8MTXP02IJWG5.3.42.D09.1.454.CMB.2.raw
  modified_base (265)..(265): a, c, t, g, unknown or other
  modified_base (285)..(285): a, c, t, g, unknown or other
  modified_base (296)..(296): a, c, t, g, unknown or other
  modified_base (299)..(299): a, c, t, g, unknown or other
  modified_base (302)..(302): a, c, t, g, unknown or other
  modified_base (304)..(304): a, c, t, g, unknown or other
  modified_base (307)..(308): a, c, t, g, unknown or other
  modified_base (312)..(312): a, c, t, g, unknown or other
  modified_base (314)..(314): a, c, t, g, unknown or other
  modified_base (319)..(319): a, c, t, g, unknown or other
  modified_base (325)..(325): a, c, t, g, unknown or other
  modified_base (329)..(329): a, c, t, g, unknown or other
  modified_base (391)..(404): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaaagaaccaattctccctgaaactgaactctatgaccgccgcagacacggctgtttattattgtacggccgtgtaacgttggactactggggccagggaaccgtggtcaccgtctcctnagcctcacaaggcccatcgntttcccccccngcnccncncanncacngnggcangcgccnggcngctgcaagactacttcgagtgcgtctcgtgaggcgggtctggacgaacggacgcgagtaagnnnnnnnnnnnnnn

SEQ ID NO: 432667 - DNA, 404 bp, Homo sapiens
  misc_feature: GZ8MTXP02IUEIX.3.42.D09.1.454.CMB.2.raw
  modified_base (391)..(391): a, c, t, g, unknown or other
  modified_base (398)..(404): a, c, t, g, unknown or other
tcagagacgcactccacgaccggtgctcgatttagacacatacgcagggaaagggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaacctggtcaccgtctcctcagcctccaccaagggcccatcggtcttccccctggcaccctcctccaagagcacctctggggcacagcggcctgggctgcctggtcaaggactacttcgagtgcgtctctgagcgggctggcaaggcncgatagnnnnnnn

SEQ ID NO: 432668 - DNA, 405 bp, Homo sapiens
  misc_feature: GZ8MTXP02FIIX5.3.42.D09.1.454.CMB.2.raw
  modified_base (401)..(405): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnn

SEQ ID NO: 432669 - DNA, 407 bp, Homo sapiens
  misc_feature: GZ8MTXP02HDCFR.3.42.D09.1.454.CMB.2.raw
  modified_base (307)..(307): a, c, t, g, unknown or other
  modified_base (392)..(407): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccacaaggcccatcgtctcccctgcaccctctccagngcactctggggcacagcggcctgggctgcctggtcaaggctactcgagtgcgtctctgagcgggctggcaagggcgcgatacggnnnnnnnnnnnnnnnn

SEQ ID NO: 432670 - DNA, 452 bp, Homo sapiens
  misc_feature: GZ8MTXP02IUE8K.3.42.D09.1.454.CMB.2.raw
  modified_base (434)..(452): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgcgcagacacggctgtttattattggtacgggccgtgtaacgttggactacgtggggccagggaaccgtggtccaccgtctcctcacgcctccacgaagggcccagtccggtccttccccctggccacccctcctaccaagcgccacctcgtggggccacgacggccggcccgtgggctcggccgtggtacaaggacctacttccgagtcgccgtctcgtgacggcgggcgtgggaccgaaggcgcgatacgnnnnnnnnnnnnnnnnnnn

SEQ ID NO: 432671 - DNA, 399 bp, Homo sapiens
  misc_feature: GZ8MTXP02GPJ9J.3.42.D09.1.454.CMB.2.raw
  modified_base (293)..(293): a, c, t, g, unknown or other
  modified_base (306)..(306): a, c, t, g, unknown or other
  modified_base (313)..(313): a, c, t, g, unknown or other
  modified_base (388)..(399): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactacgtggggccagggaaccgtggtcaccgtctcctcagcctccacaggcccatcgtctccccngcaccctctcagncacctcnggggcacagcggcctggctgcctggtcaaggctactcgagtgcgtctctgacgcgggctcggcaaggcgcatagnnnnnnnnnnnn

SEQ ID NO: 432672 - DNA, 403 bp, Homo sapiens
  misc_feature: GZ8MTXP02IUDL9.3.42.D09.1.454.CMB.2.raw
  modified_base (397)..(403): a, c, t, g, unknown or other
tcagagacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggcctgtaacgttggactactggggccagggaaccgtggtcaccgtctcctcagcctccaccaagggcccatccggtcttccccctggcaccctcctccaagagcacctctggggcacagcgcctggctgcctggtcaaggctacttccgagtgcgtctctgagcggctggcaaggcgcagtagnnnnnnn

SEQ ID NO: 432673 - DNA, 415 bp, Homo sapiens
  misc_feature: GZ8MTXP02G8LV0.3.42.D09.1.454.CMB.2.raw
  modified_base (346)..(346): a, c, t, g, unknown or other
  modified_base (405)..(415): a, c, t, g, unknown or other
tcagagacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtaccgggcgtgtaacgttggactacgtgggccagggaaccgtggtccaccgtctcctcagcctccaccaagggccccagtccgtcttcccctggcaccctcctccagagcacctcgtggggcacgagcggccgtgggcngccgtggtcaaggactacgtcgagtgcgtctctgagcggctggcgaaggcgcgatacgnnnnnnnnnnn

SEQ ID NO: 432674 - DNA, 348 bp, Homo sapiens
  misc_feature: GZ8MTXP01AZPZH.13.66.F11.1.454.CMB.2.raw
  modified_base (346)..(348): a, c, t, g, unknown or other
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttcccctggcgccctgctccaggagcacctctgggggcacagcggccctgggctgcctggtcaaggactacttcctagtacgtgactgagcgggctggcaaggcgcatagnnn

SEQ ID NO: 432675 - DNA, 347 bp, Homo sapiens
  misc_feature: GZ8MTXP01ERD7J.13.66.F11.1.454.CMB.2.raw
  modified_base (338)..(338): a, c, t, g, unknown or other
  modified_base (344)..(347): a, c, t, g, unknown or other
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccacttattattttttgacttcgtggggccagggaaccctggccaccgtctcctcagcttccaccaaggcccatcggtcttcccctggcgccctgctccaggagcactctggggcacagcggccctgggctgcctggtcaaaggctactcctagtacgtgactgagcgggctggcaaggcncatagnnnn

SEQ ID NO: 432676 - DNA, 333 bp, Homo sapiens
  misc_feature: GZ8MTXP01C3W3K.13.66.F11.1.454.CMB.2.raw
  modified_base (233)..(233): a, c, t, g, unknown or other
  modified_base (236)..(236): a, c, t, g, unknown or other
  modified_base (248)..(248): a, c, t, g, unknown or other
  modified_base (262)..(262): a, c, t, g, unknown or other
  modified_base (330)..(333): a, c, t, g, unknown or other
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccacttatattttttgacttctgggccagggaccctggccaccgtctcctcagctccacaggccatcgtctcccngcncctgctccagancactctggggcacngcggcctgggctgtctggtcaaaggactacttccagtacgtgactgagcggctggcaaggcgcatagnnnn

SEQ ID NO: 432677 - DNA, 347 bp, Homo sapiens
  misc_feature: GZ8MTXP02I6X2G.13.66.F11.1.454.CMB.2.raw
  modified_base (341)..(347): a, c, t, g, unknown or other
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccactatattttttgacttctggggccagggaaccctggccaccgtctcctcagcttccaccaagggcccatcggtcttcccctggcgccctgctccaggagcacctctggggcacagcggccctgggctgcctggtcaaggctactcctagtacgtgactgagcggctggcaaggcgcatagnnnnnnn

SEQ ID NO: 432678 - DNA, 347 bp, Homo sapiens
  misc_feature: GZ8MTXP02I9GR8.13.66.F11.1.454.CMB.2.raw
  modified_base (344)..(347): a, c, t, g, unknown or other
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttcccctggcgccctgctccaggagcacctctggggcacagcggccctgggctgcctggtcaaggctacttcctagtacgtgactgagcgggctggcaaggcgcatagnnnn

SEQ ID NO: 432679 - DNA, 348 bp, Homo sapiens
  misc_feature: GZ8MTXP02F676Q.13.66.F11.1.454.CMB.2.raw
  modified_base (342)..(348): a, c, t, g, unknown or other
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaaggcccatcggtcttcccctggcgccctgctccaggagcacctcgtggggcacagcggccctgggctgcctggtcaaggctactcctagtacgtgactgagcggctggcaaggcgcatagnnnnnnn

SEQ ID NO: 432680 - DNA, 479 bp, Homo sapiens
  misc_feature: GZ8MTXP01EDSVR.4.82.H05.1.454.CMB.2.raw
  modified_base (220)..(220): a, c, t, g, unknown or other
  modified_base (245)..(245): a, c, t, g, unknown or other
  modified_base (468)..(468): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagagctgggcctnagtgatggtctcctgcaaggcttcngatcacttcaccgctactattgcactggtgcgacaggcccctggacagggcttgagtggatggatggatcaacctataagtgtgcacacatatgcacagtactttcgtggcagggtcacgatgacgaggacacgtcatcgagcacacgcctacagtcggagctggagccgagggcctggaggacttcgacgaacgacgacggccgttgtaattcgtgtggttntcgttggtaag

SEQ ID NO: 432681 - DNA, 503 bp, Homo sapiens
  misc_feature: GZ8MTXP01B57LB.4.82.H05.1.454.CMB.2.raw
tcagagcactgtagcacgaccggtgctcgatttagtcgagctctctcgcggggcaggagtcagacccagtcaggacacagcatggacatgagggtcccgctcagctcctggggctcctgctgctctggttcccaggttccagatgcgacatccagatgacccagtctccatcttccgtgtctgcatctgtaggagacagagtcaccatcacttgtcgggcagtcagggtattagcaagtggtggcctggtatcagcagaaaccagggaaagcccctaaactcctgatctatgaagcatccagtttgcaaagtggggtcccatcaaggttcagcggcagtggatctgggacagatttcactctcaccatcagcagcctgcagcctgaagtattttgggctaactttacactgtacaacaggactaactagtttccctatcaaccttcggccaaagggcaacgcttaggagaacgttaaacgaactgtaggccttgcaaccgtaa

SEQ ID NO: 432682 - DNA, 531 bp, Homo sapiens
  misc_feature: GZ8MTXP01B918X.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcaagtggtgctggtatcagcagaaaccagggaaacgcccctaaactcctagatctatagaagcatccagtttgacaaagtggggtccatcaagttcagcggcagtggatcgtgggacagtattcactctacacatcagcagcctgcagcctagaagtattttggactaacttactactgtacaacaggtactaaactagtttccctatcctaaccgttcggaccgaaacgggaccaacggacttagggaagttaacgtttaaaacgaacgtgtacggcttacgccaaccgtaac

SEQ ID NO: 432683 - DNA, 547 bp, Homo sapiens
  misc_feature: GZ8MTXP01CTTNA.4.82.H05.1.454.CMB.2.raw
  modified_base (249)..(249): a, c, t, g, unknown or other
tcagagcactgtagcacgaccggtgctcgattagtcgagctctctcgcggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcaagtggttggcnggtatcagcagaaaccagggaaagcccctaaatcctgatctatgaagcatccagtttgacaaagtgggtccatcaaggtcagcgacagtgatcgtagggacagtattcactctcaccatcagcagccctgcagcctagaagtattttgactaaactttacactgtacaaactaggacctaactagtttccctaatcctaaccttcggccctaaagggccaaacccgggtacttaggggaattaacgtttaaaacccgggaaacttggtacgggtccttacgtaaccgttaaccgtaac

SEQ ID NO: 432684 - DNA, 514 bp, Homo sapiens
  misc_feature: GZ8MTXP01DQXL5.4.82.H05.1.454.CMB.2.raw
  modified_base (244)..(244): a, c, t, g, unknown or other
  modified_base (268)..(268): a, c, t, g, unknown or other
tcagagcactgtagcacgaccggtgctcgatttagtcgagctctctcgcggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtatagcaagtgtggcnggtatcagcagaaaccagggaaancccctaaatcctagatctatgaagcatccagtttgcaaagtgggtcccatcaaggttcagcggacagtggatcgtgggacagatttcactctcaccatcagcagcctgcagcctagaacgtattttggactaactttactactgtacaacagactaactagtttacccatccaaccttcggaccctaaaggggaccaacgtacgttaggagttaacttaaacgaactgaggcttgaacaaccgtaa

SEQ ID NO: 432685 - DNA, 526 bp, Homo sapiens
  misc_feature: GZ8MTXP01DA7YS.4.82.H05.1.454.CMB.2.raw
  modified_base (489)..(489): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcaagtggtgctggtatcagcagaaaccaggaaagcccctaaactcctgatctatgaagcatccagtttgacaaagtggggtcccatcaaggttcagcggacagtggatcgtgggacagatttcactctcaccatcagcagcctgcagcctagaagtattttggactaactttactactgtaccaaacaggtactaactacgtttaccctattccaaccttcggacctaaacggggacctaacggacttagggnaaacgtttaaacgaacgtgtaggcttagcaaccgtaa

SEQ ID NO: 432686 - DNA, 470 bp, Homo sapiens
  misc_feature: GZ8MTXP01EUGSE.4.82.H05.1.454.CMB.2.raw
  modified_base (248)..(248): a, c, t, g, unknown or other
  modified_base (422)..(422): a, c, t, g, unknown or other
  modified_base (443)..(443): a, c, t, g, unknown or other
  modified_base (457)..(457): a, c, t, g, unknown or other
  modified_base (459)..(459): a, c, t, g, unknown or other
  modified_base (461)..(470): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagcctggggcctcagtgatggtctcctgcaaggcttcnggattcaccttcaccggctactatttgcactggtgcgacaggcccctggacaagggcttgagtggatgggatggatcgaaaccctaagtaaagtggtgccaacacactatgcacagtactttcgtgggcagggtcaccatgaccagggacacgtccatccagcacagccctaanagtggagcgtgaggcggcggnggcgaggcgcgagngngnnnnnnnnnn

SEQ ID NO: 432687 - DNA, 557 bp, Homo sapiens
  misc_feature: GZ8MTXP01A7N2W.4.82.H05.1.454.CMB.2.raw
  modified_base (399)..(399): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggcgggcgagtcagggttattagcaagtggttggctggtatcagcagaaaccagggaaagcccctaaatcctagatctatagaagcatccagtttgacgtaaagtgggtccatcaggttcagcggcagtgatcgtgggacagtattcactctacacctatcagctagcctgcagcctagaagtnttttggactaactttactactgtaccaacaggtactaaactcgttttaccctatcctaaccttcgggacctaaacggggacctaaacggtacttagggaacgttaacgtttaaaaccggaacgttggtacgggtccttacggaaccttaacccggtaa

SEQ ID NO: 432688 - DNA, 512 bp, Homo sapiens
  misc_feature: GZ8MTXP01DW8KL.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcaagtggtggctggtatcagcagaaaccagggaaacgcccctaaactcctgatctatgaagcatccagtttgacaaagtgggtccatcaaggttcagcggacagtggatcgtgggacagatttcactctcaccatcagcagcctgcagcctagaagtattttaggactaacttactacgtgtacaacaggtactaactgtttaccctatccaaccttcggaccaacgggacacgtacttggagttactaaacgaactgtacggcttcgcaacctaa

SEQ ID NO: 432689 - DNA, 561 bp, Homo sapiens
  misc_feature: GZ8MTXP01CJGUM.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtatagcagtggtgctggtatcagcagaaaccaggaaacgcccctaaactcctgatctatgaagcatccagtttgacaaagtcgggtaccatcaaggttcagcggacaggtggatcgtgggactagtactttcactctcaccatcagcagcctgcagcctagaagtatttggactaacttactactcgtacaaacgacggtaccttaacgtactttaccctatccctaaccgtttccgggacctaaagggggcctaaacggtaacttacggggaattaaatttaaaacccgggaacttgggtacgggtacttacggtaaccttaaccgtaacg

SEQ ID NO: 432690 - DNA, 502 bp, Homo sapiens
  misc_feature: GZ8MTXP01B072Z.4.82.H05.1.454.CMB.2.raw
  modified_base (469)..(469): a, c, t, g, unknown or other
  modified_base (496)..(496): a, c, t, g, unknown or other
tcagagcactgtagcacgaccggtgctcgatttagtcgagctctctcgcggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcaagtggttggctggtatcagcagaaaccagggaaagcccctaaactcctgatctatgaagcatccagtttgcaaagtggggtcccatcaaggttcagcggcagtggatcgtgggacagatttcactctcaccatcagcagcctgcagcctgaagtattttggactaacttacctactgtcaacaggactaactgtttccctatcctaaccttcggcctaaagggcacgacnggagacttaaacgactgtgcgttgtcnccgtaa

SEQ ID NO: 432691 - DNA, 536 bp, Homo sapiens
  misc_feature: GZ8MTXP01C80L9.4.82.H05.1.454.CMB.2.raw
  modified_base (197)..(197): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctacatctgtagganacagagtcaccatcacttgcgggcagtcaggggtattagcaagtggttggcctggtatcagcaagaaaccagggaaacgcccctaaactcctgatctatgaagcatccagtttgacaaagtcggggtaccatccaaggttcagcggcaagtggaatcgtgggacagtattcactctcacatcagcagcctgcagcctagaagtattttcgactaacttactactcgtacaacaggctaaacctcgtttaccctatctacccgttcggaccgaaacggggtacacgtaactgggaagttaacgttaaacgaactggtcggactggacctaacgaacgttc

SEQ ID NO: 432692 - DNA, 600 bp, Homo sapiens
  misc_feature: GZ8MTXP01DGRSI.4.82.H05.1.454.CMB.2.raw
  modified_base (197)..(197): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcgagtcgagggtattagcaagtggtggctggtatcagacaagaaaccgagggaaacacccctaaactcctagatactaagtagaagctatcctagtttgacgtaaaggtcggggtacccaagtacgtaaaggttcaaggcggaacaggtggatcgtaggggactagtactttcactctacaccatcagcagcctgcagctagtaatattttcggactaaactttacatcgtacaacgaggtacttaaacgtactttacccctattcccgtaaccgttccgggaacccgtaaaggggacctaaaccggaacgttacggggaaattaaacgtttaaaaccgaacgtttggtcgggacgttacgaaccgttaaacccgttg

SEQ ID NO: 432693 - DNA, 557 bp, Homo sapiens
  misc_feature: GZ8MTXP01BWM67.4.82.H05.1.454.CMB.2.raw
  modified_base (197)..(197): a, c, t, g, unknown or other
  modified_base (356)..(356): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcagggttattagcaagtggttggctggtatcagcagaaaccagggaaacgcccctaaactcctgatctatgaagcatccagtttgacaaaggtcggggtcccatacaaggttcagcggacagtggatcgngggacagtattcactctcaccatcagcagcctgcagctgaatatttcggactaactttactactgtaccaagtacgtactaactcgtttaccctatccctaaccgttcggaccgtaacggggacaacggtaccttagggaacgttaaacgtttaaaaccggacgttcgggtcgggtcttacggaacccgaaccgtttaacg

SEQ ID NO: 432694 - DNA, 497 bp, Homo sapiens
  misc_feature: GZ8MTXP01BJ3X6.4.82.H05.1.454.CMB.2.raw
  modified_base (249)..(249): a, c, t, g, unknown or other
  modified_base (364)..(364): a, c, t, g, unknown or other
  modified_base (376)..(376): a, c, t, g, unknown or other
  modified_base (410)..(410): a, c, t, g, unknown or other
  modified_base (448)..(448): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagcctggggcctcagtgatggtctcctgcaaggtcttcnggattcaccttcaccggtctactatttgcacgtgggtgcgacacggccccctggacaagggtcttgagtggatgggatggatcaacctaataagtgtgccacacactatgcaacngtacttttcggnggcgaggtcacgagtacgacgaggacacgtacancgagacacacgtacctacgagtggacgctgagcgaggngtgagtagcgtacgacgacgcggttcgtgtatcgtgtgttgtcgttgtg

SEQ ID NO: 432695 - DNA, 558 bp, Homo sapiens
  misc_feature: GZ8MTXP01DFPOR.4.82.H05.1.454.CMB.2.raw
  modified_base (197)..(197): a, c, t, g, unknown or other
  modified_base (470)..(470): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcacatcacttggtcgggcgagtcgagggtattagcaagtggtgctggtatcagcagaaacgaggaaacacccctaaatcctagatctatagaagcagtcctagttgacgtaaaggtcgggtacccaagtacgaaaggttcaaggtcggacgaaggtcggatcgtagggactagtactttcacttcacacatcagcacgcctagcagctagaagtatttcgactaacttacactgtacaacgacgtacttaactacgtttacctacnccgtaacccgttcggacctaaagggaccgtaacgtaacgttagggaacttaaagtaaacgtacgttgcggtcgactcgttaaccgtaa

SEQ ID NO: 432696 - DNA, 573 bp, Homo sapiens
  misc_feature: GZ8MTXP01CAIAZ.4.82.H05.1.454.CMB.2.raw
  modified_base (245)..(245): a, c, t, g, unknown or other
  modified_base (250)..(250): a, c, t, g, unknown or other
  modified_base (267)..(267): a, c, t, g, unknown or other
  modified_base (410)..(410): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcagtggtgcnggatnagcagaaacaggaaacncccctaaactcctagatctatgaagcatcctagtttgacgtaaagtcggggtacccagtcgaaaggttcgaggcggacaggtggaatcgtaggggactagtactttcactctacacatcagcagcctagctagcctagaattntttacggaccttaaattacctacgtgtaaccaacgtacggtaacctaaccgtacgtttacccctatccctaacccgttacggaccgaaacgggttcaaacggtaccgttagggacgttaaacgttaaaacgacgttgacggtcttacgtcccaaccgttaacg

SEQ ID NO: 432697 - DNA, 555 bp, Homo sapiens
  misc_feature: GZ8MTXP01A4YCI.4.82.H05.1.454.CMB.2.raw
  modified_base (278)..(278): a, c, t, g, unknown or other
tcagagcactgtagcacgaccggtgctcgatttagtcgagctctctcgcgggggcaggagtcagacccagtcaggacacagcatggacatggacgggtccccgctcagctcctggggctcctgctgctctggttcccaggttccagatgcgacatccagatgacccagtctccatcttccgtgtctgcatctgtaggagacagatcaccatcacttggtcgggcgagtcagggtattagcgtaagtggttgctggtatcagcagaaaccagggaaacncccctaaatcctagatactatagaagcatctagttgacaaaggtcgggtacccaagtcgtaagtcgaggcgacaggtggatcgtagggactagtattcactctcacctagtccagcaacgcctagacacgcgtagaagttatttcggaaccttaacttactactagtcaaacgacgtactaacgtctttaccctatccaaccgttcggaccgaagggttaccacgtaacgttagggacttaaagttaaacgacgtggtacggcttacgccaacgttc

SEQ ID NO: 432698 - DNA, 504 bp, Homo sapiens
  misc_feature: GZ8MTXP01ALRNP.4.82.H05.1.454.CMB.2.raw
  modified_base (248)..(248): a, c, t, g, unknown or other
  modified_base (333)..(333): a, c, t, g, unknown or other
  modified_base (348)..(348): a, c, t, g, unknown or other
  modified_base (366)..(366): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagcctggggcctcagtgatggtctcctgcaaggcttcnggattcaccttcaccggctactatttgcacgtgggtgcgacaggcccctggacaagggcttgagtggatggatggatcaacctanaagtggtcgcacacnctatgcacagtactttgngggcagggtcaccgatgaccagggacacgtccatcgagcacacgacctacgagtggacgcctggagcgaggctggagtattcgtacggacgaccgacggttcccgttggtacttaacgtggtgttgttcgttaaggtg

SEQ ID NO: 432699 - DNA, 593 bp, Homo sapiens
  misc_feature: GZ8MTXP01BV9GN.4.82.H05.1.454.CMB.2.raw
  modified_base (247)..(247): a, c, t, g, unknown or other
  modified_base (564)..(564): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtcgtggggctggaggtagaagagccgtgggcctgagtgatggtctctgcagtctgngatcactcgacgtctactattgctacgtggtgcgacgacggccccgtaggacgagggtcttggacggtggagtgggatggactacaacctagtagtggcgaccacacgactatgactacacgttactttcggtacgggcgtacgggttaccaacccgtagtaccggaaccgaacggggaaccctaccggtacctacgtaccggaacggaccaaccgaccgtacccttaagagtacggaacgtcgtacggaacgtccggaagggtctacgggacgtacgttacgtacgggaccgaacgttccgggttccgttaagttnttaacgttggtcggttgttcgttggtaag

SEQ ID NO: 432700 - DNA, 512 bp, Homo sapiens
  misc_feature: GZ8MTXP01ALKMF.4.82.H05.1.454.CMB.2.raw
  modified_base (222)..(222): a, c, t, g, unknown or other
  modified_base (247)..(247): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagagcctggggcctnagtgatggtctcctgcaaggcttcnggattcaccttcaccggctactatttgcacgtggtgcgacacggcccctggacaagggcttggagtggatgggatggatcgaaccctaagtagtggtgccacacactatgacactagtactttcgtgggcgtagggtcaccgagtacgaccgagggacacgtccatcgagcacacgtacctacgagtcggagccgtaggacgccgaggctaggagtacttcgtaggacgacgcggttccgtgtacttgtgtgttcgtgttgtaag

SEQ ID NO: 432701 - DNA, 604 bp, Homo sapiens
  misc_feature: GZ8MTXP01A66ZW.4.82.H05.1.454.CMB.2.raw
  modified_base (197)..(197): a, c, t, g, unknown or other
  modified_base (253)..(253): a, c, t, g, unknown or other
  modified_base (275)..(275): a, c, t, g, unknown or other
  modified_base (388)..(388): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtatctgcatctgtagganacagagtcaccatcacttggcgggcgagtcagggtatagcaagtggtggctggtancagcaagaaaccgagggaaacncccctaaactcctgatctatgaagctatcctagtttagacgtaaaggtcggggtacccagttacgaagggttcaggcggacaggtggatcgtaggggactagtacttcactcncacatcagcacgcctgcgacgtcctaggaattatttcggacttaactttactactagtaccaacgtacggtaccttaacctccgtttaccctactcccgtaacccgttccggacccgaaacggggacctaaaccggtaacgttacggggaaacgttaaacgttaaaaccggacgttaacgggtcgggtaccttacggaacccgttaaccgtttccg

SEQ ID NO: 432702 - DNA, 604 bp, Homo sapiens
  misc_feature: GZ8MTXP01ETOBM.4.82.H05.1.454.CMB.2.raw
  modified_base (250)..(250): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagccccactcccaggtgcagctgatgcagtctgggctgaggtgaagagccgtggggcctgagtgatggtctcctgcgaaggtcttcnggacttcaccttcaccggtctactatttgctacgtgggtcgcgacgacggccccgtaggaccgaagggtcttaggagtggagtcggggattgggactaccgaaacccgttaataacgggtggtcgacccaaacgacctaacttagtcggacctaacgtacgttacgtttttcgagggggacctaaggggttaccaaacccgtagtacggaacccgaacgggaccaccggttaccataccggagaccgaacacgaccctagagtggaacgtctaggacgcgaagggctaggagacgttcgcggaacgaccgttcggccgttaaggttattaacgtggtgttcgttgttggttaag

SEQ ID NO: 432703 - DNA, 555 bp, Homo sapiens
  misc_feature: GZ8MTXP01BAV9I.4.82.H05.1.454.CMB.2.raw
  modified_base (247)..(247): a, c, t, g, unknown or other
tcagagcactgtagcacgaccggtgctcgatttagtcgagctctctcgcgggggcaggagtcagacccagtcaggacacagcatggacatggagggtccccgctcagctcctggggctcctgctgctctggttcccaggttccagatgcgacatccagatgacccagtctccatcttccgtgtctgcatctgtaggagacagagtcaccatcacttggcgggcagtcagggtatagcaagtggtgcnggtatcagcagaaacgaggaaacacccctaaactcctagatctatagaagcatccgagtttagacgtaaaggtcggggtacccatacgtaaggttcaggcgacaggtggatcgtagggacagtactttcactctacacatcagcacgcctagcagcctagaaagttctttacgactaaacttactatgtacaacaggtaacctaactaccgtttaccctatccaaccgttcggaaccaaacgggacaacgtacgttagggaacttaacttaaacggacttggacggacttacgccgttaaccgttaag

SEQ ID NO: 432704 - DNA, 658 bp, Homo sapiens
  misc_feature: GZ8MTXP01C0EUA.4.82.H05.1.454.CMB.2.raw
  modified_base (224)..(224): a, c, t, g, unknown or other
  modified_base (287)..(287): a, c, t, g, unknown or other
tcagagcactgtagcacgaccggtgctcgatttagtcgagctctctcgcgggggcaggagtcagacccagtcaggacacagcatggacatggacgggtccccgctcagctcctggggctcctgctgctctggttcccaggttccagatgcgacatccagatgacccagtctccatcttccgtgtctgcatctgtaggagacagagtcaccatcacttggcgggnagtcagggtatagctaagtggttgcctggtatcagacaagaaaccgaggaaacgcccctaaancctgatctatagaagcatcctagttttgacgtaaaggtcgggggtaccctaagtacgaaaggttcgacggcggaaccgtagggtgggtaagtcgtacgggggactaggtactttcacttcctacaacctatcgaagtccaacgtccgtgccacgcctaggtaaacgttcgttttaggaaccttaaacctttaactacgttacgtaaccgtaaaccgtagggttaaaccttaacgttaccgtttaccctacttacccgtaacccgtttccgggacctaaacgggttaccgaaacggacgttaacgggttaacttaaacgtttaaaaacgtaccgttgggtcggtaccgttactaacccggttaacgttaacg

SEQ ID NO: 432705 - DNA, 606 bp, Homo sapiens
  misc_feature: GZ8MTXP01A87YN.4.82.H05.1.454.CMB.2.raw
  modified_base (276)..(276): a, c, t, g, unknown or other
tcagagcactgtagcacgaccggtgctcgatttagtcgagctctctcgcggggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcaaggtggtggctggtatcagcaagaaaccgagggaaacnccccgtaaactcctgatctatagaagcatcctagtttgacgtaaaggtcggggtaccaacgtcgtaaaggttcgaacggcggacgagggtggtaatcgtaggggactaggttactttcaactctacaccaagtcagcgtacgcctggactacgccttaggaacgttattttcgggaacttaacttactactgtaacaaacgtacgacttaacgtacgtttacccatcctaacccgttcggaaccgaacgggacctacggtaaccgttggaaacgttaacgtttaaaacccggagtaacggttacggcttacgaacccgttaaccgttaac

SEQ ID NO: 432706 - DNA, 669 bp, Homo sapiens
  misc_feature: GZ8MTXP01D5WFI.4.82.H05.1.454.CMB.2.raw
tcagagcactgtagcacgaccggtgctcgatttagtcgagctctctcgcgggggcaggagtcagacccagtcaggacacagcatggacatggacgggtccccgctcagctcctggggctcctgctgctctggttcccaggttccagatgcgacatccagatcgacccagtctccatcttccgtgtctgcatctgtagtagagacgagtacgtaccaacctatcctacgttcgggtcgggacgtacggtacggtaagggttagttacgaggtaagggttcgggttcggcgttaggtactacgaacggaacgaaacgaaaccggtaacgggaaaccctacccctaaacgtctagtactacgtagtagaacgtctactacgttagttacgaacgtagggtccggtaccctagtacggtacggtcagggccgtagtgggtagtacgtcgggaagtactaagttcttacacctctaaccacgtatacgacgtacgtaccgtcctcgacgtacgtcgtaaagttaacggtttcgtttacaaactttaaccttacgtacgacgtaaacgagaaccgttacctacgtttaccgttacctacgtaaccgtacgttcggaaacgttaaggactacgagttaagaacgtaaagtacaagttggacgctaacgaaccctaa

SEQ ID NO: 432707 - DNA, 631 bp, Homo sapiens
  misc_feature: GZ8MTXP01BTV9K.4.82.H05.1.454.CMB.2.raw
  modified_base (160)..(160): a, c, t, g, unknown or other
  modified_base (249)..(249): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccanaggagtccactcccaggtgcagctgatgcagtcgtgggctgaggtgaagagccgtgggcctgagtgatcggtctctgcaaggtcttcgnggtattccacccttcgaccggtcttacttatttcgactacggtggtcgcgtacgacggtcccccgtaggaccgaagggtcttaggaggttggaagtggggaactacgggaactacccgtaaacccgttaagtaacggtcgggtcgaccctaaacgtacctaacgttacgtacgacctaaacgtacgtttaccgtttttcggcggggtactacggggtacaacccgtagtaccggaccggaagggacctacggtaccaatccgagacccgaacgacgtaccctacgaggtaggacgcgtaggagtaccgaggcttaggagtacgttccgaaggacggaccgttcggttccgttaagttagtcgtggtgttcgtgttggtaagg

SEQ ID NO: 432708 - DNA, 753 bp, Homo sapiens
  misc_feature: GZ8MTXP01EP889.4.82.H05.1.454.CMB.2.raw
  modified_base (197)..(197): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggcgggcagtcgagggtatagcgtaagtggtggctggtatcagacaagaaaccgagggaaactacccctaaactcctagatctatacgaagctactcctagtttacgacgtaaacggtcggggtaccctaatacggtaaaggttcgaacggtccggaacgtaagggttcgggtaaagttccgggtagggggtaaacctaagggtttaactttaccgtaaccttcctaacctaacccgaacttacgaacgtaccgtaaacggtcccttagggaccctaacggtaccccgttaaaggttaaacgtttacgtttttaccgggaaacctttaaacctttaaccgttaaccgttacggtaaacctaaaccgtaacgggtaaccctttaaaccgttacccggttttaaccctaaccgttacctaaccccggttaacggggaacccgtaaacggggttaccaacgggtaacgttagggaaacgttaaacgtttaaaacggacgttcgggtacgggtaccttacgtaacccgttaaccgttaaccg

SEQ ID NO: 432709 - DNA, 666 bp, Homo sapiens
  misc_feature: GZ8MTXP01CAL7K.4.82.H05.1.454.CMB.2.raw
  modified_base (199)..(199): a, c, t, g, unknown or other
  modified_base (461)..(461): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatcgacccagtctccatcttccgtgtctgcatcgtgtagganacagatcacatcacgttggcgggacgtagtcgtagggttatagcgtaaggttggtggtccgtggtatcaggacaaacggaaaccgaacgggtaaacctacccctaaactccgtagacttacgtatacggaacgtctacgttaccgtaggtttacgaacgtaaacgggtcgggtaccctacgtacgaaggttcgacggcggaacgtaggtcggtagtaccgtagggactagtacttacgactcacactatacagcgacgtccngtaccgacgtctagtaacgtttacttacggaacttaacgttactacgtacgtaccaacgtacgtaaccgttaacttaccgtttaccctacgtacccgtaaccggttccgaccggtaaacggaccgtaacggtaacgttacgggttaaacgttaaacgttaaaccggtacgtcggtacggacttaccgtaaccgttaaccttaacg

SEQ ID NO: 432710 - DNA, 648 bp, Homo sapiens
  misc_feature: GZ8MTXP01CXW7U.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctcatcttccgtgtctgcatctaggtaggagacagagtcaccatcacttggtcgggcagtcgagggtattagctaaggtggttaggcctggtatcagacaagaaaccagggaaacacccctaaatcctagatactatagaagctatccagtttgacgtaaaggtcggggtacccataccgaaggttcaaggcgactaggtgagtcgtaggggactagtacttcgactctacaacctatacgagacagcccttagacgacgtacctaggtaaagttacttttacgggaaccttaaactttaacctaacgttacgtaaccaaacgtaggtaaccctaaacgttacgttttaccccacttacccggtaaccgtttaccgggaaccgtaaacgggaacctaacggtaaccgttaggggaaacttaaacgtttaaaacccggaagtttcggttcgggaccttacggtaacccgttaactttaaccg

SEQ ID NO: 432711 - DNA, 496 bp, Homo sapiens
  misc_feature: GZ8MTXP02II6VJ.4.82.H05.1.454.CMB.2.raw
  modified_base (425)..(425): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcaagtggtgctggtatcagcagaaaccagggaaacgcccctaaatcctgatctatgaagcatccagtttgcaaagtgggtccatcaagttcagcgcagtggatcgtgggacagatttcactctcaccatcagcagcctgcagcctgaagtattttgactaacttactactgtacaacaggcttaaacngtttacccatccaccttcggccaacgggacacgactacggataattaaacgactaggtacgctcgcaccta

SEQ ID NO: 432712 - DNA, 535 bp, Homo sapiens
  misc_feature: GZ8MTXP02HSG6Y.4.82.H05.1.454.CMB.2.raw
  modified_base (197)..(197): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggtattagcaagtggtgctggtatcagcagaaaccagggaaacgcccctaaactcctgatctatgaagcatccagtttgcaaagtggggtcccatcaagttcagcgcagtggatctgggacagatttcactctcaccatcagcagcctgcagcctgaagtattttgactaacttactactgtacaacaggactaactagtttccctatacctacctttcggacccaaacggggtaccaacggtaccgtagggtaacgtaacgttaaaacggaaccgtaggttacggcgtacggaccaacccttaacg

SEQ ID NO: 432713 - DNA, 514 bp, Homo sapiens
  misc_feature: GZ8MTXP02HC3YU.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcaagtggttgcctggtatcagcagaaaccagggaaagcccctaaactcctgatctatgaagcatccagtttgacaaagtggggtcccatcaaggttcagcggcagtggatcgtgggacagatttcactctcaccatcagcagcctgcagcctagaacgtattttgactaacttactatacgtacaacgtaggctaaactacgtttaccctatcctaccttcggaccaacgggacacgactaggagtaattaaacgacgtagtacggctacgacaccta

SEQ ID NO: 432714 - DNA, 541 bp, Homo sapiens
  misc_feature: GZ8MTXP02IU61W.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcaagtggtggctggtatcagcagaaaccagggaaagcccctaaactcctgatctatgaagcatccagtttgacaaagtggggtcccatcaaggttcagcggcagtgggatctggggacagtatttcactctcaccatcagcagccctgcagcctgaagtattttgactaactttactactgtacaacaggtactaaactacgtttaccctattcctaccgtttcggaccgtaaacggggaccaacgtaccgtaggagtaaactttaaaacggaaacttaggtacggactacggactaacccgta

SEQ ID NO: 432715 - DNA, 591 bp, Homo sapiens
  misc_feature: GZ8MTXP02I7S85.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcaagtggttggctggtatcagcagaaaccagggaaacgcccctaaactcctgatctatgaagcatccagtttgacaaagtggggtccatcaaggttcagcggcagtggatcgtgggacagatttcactctcaccatcagcagcctgcagcctgaagtatttgactaacttactactagtaccaaacgtacggtaccttaaactacgtttttacccctaattaccctaacccgtttaccgggacccgtaaacgggggtaaacccaacggtaaaccgtttacggggaattaaaacgtttaaaaacccgggtaaaacttgggttacggggaccttacggaccgtaaccccgtttaacg

SEQ ID NO: 432716 - DNA, 514 bp, Homo sapiens
  misc_feature: GZ8MTXP02GQ7NJ.4.82.H05.1.454.CMB.2.raw
  modified_base (235)..(235): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtatagnaagtggtggctggtatcagcagaaacagggaaacgcccctaaactcctgatctatgaagcatcctagtttgacaaaggtcggggtaccagtcgaaggttcagcggcagtggatcgtagggacagtatttcactctcacatcagcagcctgcagcctagaaagtatttgacttaacttactactgtaccaaacaggtactaaactacgtttaccctatcctaccgttcggaccgtaaacgggacacgactaggataataaacgactgcgactcgacacta

SEQ ID NO: 432717 - DNA, 521 bp, Homo sapiens
  misc_feature: GZ8MTXP02FYJ95.4.82.H05.1.454.CMB.2.raw
  modified_base (424)..(424): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcaagtggttggcctggtatcagcagaaaccagggaaagcccctaaactcctgatctatgaagcatccagtttgcaaagtggggtccatcaagttcagcggcagtggatcgtgggacagatttcactctcaccatcagcagcctgcagcctgaaagtattttgactaaactttactactgtaccaaanacggacttaaacacgttttacccatcctaacctttcggacccaaaggggaccacgacgtaggaagtaacttaaaacgaactgtacggctagcaccta

SEQ ID NO: 432718 - DNA, 547 bp, Homo sapiens
  misc_feature: GZ8MTXP02IV151.4.82.H05.1.454.CMB.2.raw
  modified_base (197)..(197): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggtattagcaagtggtggctggtatcagcagaaaccagggaaacgcccctaaactcctgatctatgaagcatccagtttgactaaaggtcggggtaccatcaaggttcagcggcagtggatcgtgggacagtatttcactctcaccatcagcagcctgcagcctagtaagtattttcgactaacttactactcgtacaacgaggtactaaactacgtttaccctatcctaccgttcggacctaaacgggaaccaacgtaccgtaggtaacgtaaacttaaaacggaacgttaggtacgggtacttacgacctaactacg

SEQ ID NO: 432719 - DNA, 549 bp, Homo sapiens
  misc_feature: GZ8MTXP02H0DW0.4.82.H05.1.454.CMB.2.raw
  modified_base (196)..(196): a, c, t, g, unknown or other
  modified_base (419)..(419): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctcatcttccgtgtctgcatctgtagganacagagtcaccatcacttggtcgggcagtcagggttattagcaagtggttggcctggtatcagcagaaaccgagggaaacgcccctaaactcctgatctatgaagcatctagtttgacgtaaaggtcggggtacccagtacgtaaaggttcaaggcggcaggtgggatcgtagggactagtactttcactctacaccatcagcagcctgcagtctagaagttnttttgacttaacttactactagtacaacgagtactaactacgtttaccatcctacgttacggaccaacgggtacaacgtacgtacggaagtaacgttaaaacgacgtaggtcggactacgacctaactac

SEQ ID NO: 432720 - DNA, 528 bp, Homo sapiens
  misc_feature: GZ8MTXP02GS2V1.4.82.H05.1.454.CMB.2.raw
  modified_base (197)..(197): a, c, t, g, unknown or other
  modified_base (399)..(399): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggtattagcaagtggtggctggtatcagcagaaaccagggaaacgcccctaaactcctagatctatgaagcatccagtttgacaaaggtcggggtccatcaaggtcagcggcaggtggatcgtgggacagtatttcactctcaccatcagcagcctgcagcctagaacgtnttttacgactaacttactactgtaccaaataggactaaacgtacgtttaccctatcctacccgttcggacctaaacgggaccacgacgtaggaataactaaacgaactggtacgactacgactacctag

SEQ ID NO: 432721 - DNA, 566 bp, Homo sapiens
  misc_feature: GZ8MTXP02FUG7K.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtatagcaagtggtggctggtatcagcagaaaccaggaaacgcccctaaatcctagatctatgaagcattcagtttgacgaaagtcggggtccatacgaaggttcaggcgcagtggatcgtgggacagtatttcactctcaccatcagcacgcctgcagcctagaagtattttgactaacttactacgtatacaacgtagtacttaaacgtactttaccctacttcctaaccgtttacggaaccgtaaacgggggaaaccacggtaacgttaacgggaagtaaaacgtttaaaaccggtaaacgttgggtacgggtcttacggaccgtaactaacg

SEQ ID NO: 432722 - DNA, 570 bp, Homo sapiens
  misc_feature: GZ8MTXP02HPCY5.4.82.H05.1.454.CMB.2.raw
  modified_base (197)..(197): a, c, t, g, unknown or other
  modified_base (412)..(412): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcagggtattagcaagtggtgcctggtatcagcagaaaccgaggaaacgcccctaaactcctgatctatgaagcatcctagtttgacgtaaaggtcggggtacccagtcgtaaaggttcaaggcggacaggtggatcgtagggactagtatttcactctcaccatcagcagcctgcagctagaagtntttgactaacttactactgtacaacacggtactaactacgtttaccctacttacctaccgtttcggaccgtaaaacggggaccaaacggtaccgttagggaaacgttaaacgtttaaaaccgaaacttgggttacggacttacgacctaaccgttacg

SEQ ID NO: 432723 - DNA, 498 bp, Homo sapiens
  misc_feature: GZ8MTXP02IVUXO.4.82.H05.1.454.CMB.2.raw
  modified_base (365)..(365): a, c, t, g, unknown or other
  modified_base (404)..(404): a, c, t, g, unknown or other
  modified_base (443)..(443): a, c, t, g, unknown or other
  modified_base (497)..(497): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctgggctgaggtgaagaagccgtggggcctcagtgatggtctcctgcaaggcttctggattcaccttcaccggctactatttgcactgggtgcgacaggcccctggacaaggcttgagtggatggatggatcaacctatacgtgtgccacacactatgacacagtacttttcngggcagggtcacactagaccgaaggacgacgtacctacncacgcacgacgacctacagtaggacgcgtacgagacggngtacgagagacgtacgacgacgacgacgacgtgtatacgtcgtagtcgtcgtgng

SEQ ID NO: 432724 - DNA, 549 bp, Homo sapiens
  misc_feature: GZ8MTXP02GSNCP.4.82.H05.1.454.CMB.2.raw
  modified_base (272)..(272): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcaagtggtggctggtatcagcagaaacagggaaacncccctaaactcctgatctatgaagcatcctagtttgactaaaggtcggggtacccatcaaggttcaggtcggacaggtggatcgtaggggactagtatttcactctacaccatcagcagcctgccagcctagaagtattttagacttaacttacttactagtacaacgaggtactaaactcgtttaccctatcctaaccgttccggaccaaacgggaccaacgtacgtacggaacgtaagtaaaaccgacgtacggtacgtactacgactacctacg

SEQ ID NO: 432725 - DNA, 567 bp, Homo sapiens
  misc_feature: GZ8MTXP02HVKFK.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcgagggtatagcaagtggtgcctggtatcagcagaaaccgaggaaacgacccctaaactcctgatctatagaagcatcctagtttgacgaaaggtcggggtaccacgtacgtaaggttcaggcggacaggtggactcgtgggactagtactttcaccttctacaccatcagcacgcctgcacgccttagaagttattttacgacttaactttactactcgtacaacgacggtactaacgtacgtttaccctatcctaccgttacggaccgaaacggtacaccggtacgtacggaacgtaacgttaaaaccgacgttacggtacgacgtcgacctactacg

SEQ ID NO: 432726 - DNA, 666 bp, Homo sapiens
  misc_feature: GZ8MTXP02IYD61.4.82.H05.1.454.CMB.2.raw
  modified_base (197)..(197): a, c, t, g, unknown or other
  modified_base (294)..(294): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcgaggtcgaaggggttattaggcgtaaggttggttggccgtaggtatcagacaagaaaccgaagggaaaccncccctaaactcctagactactatagaacgcactccgtagtttacgacgtaaggtcgggtaccagtacgtaacggttcaggcgacgtagtggtactcggtagggactagtactttcgacctctaccacctactacgagtccaacgtccctagaccgacgtaccgtaaggtaaacgttacgtttttaacgaacctttaaacctttaccgtacgttacgtaaaccgaacgtaacggtaccttaaacgttccgttttaccctacttacccgtaaccgttaccgggaaccgtaaacgggtaacctaacggtacgtaacgggtaaacgttaaacgttaaaaccggacgttacggtacggactacggacctaacttacg

SEQ ID NO: 432727 - DNA, 579 bp, Homo sapiens
  misc_feature: GZ8MTXP02GS0TF.4.82.H05.1.454.CMB.2.raw
  modified_base (416)..(416): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcaagtggtggctggtatcagcagaaaccgagggaaacgcccctaaactcctagatctaatgaagcatcctagtttgacgtaaaggtcggggtaccagtacgaaggttcaggcggacagtggatcgtagggacagtatttcactctacacatcagcacgcctgcacgcctagtaaagttntttacgacttaacttactactacgtaccaaacgacggtacttaaacctaccgtttaccctaacttaccctaccggtttacggaccgtaaacggggaccaaccggtacgtacgggaacgttaaacgttaaaccgacgttacggtcgtaacgtcgaccacttacg

SEQ ID NO: 432728 - DNA, 597 bp, Homo sapiens
  misc_feature: GZ8MTXP02HD58X.4.82.H05.1.454.CMB.2.raw
  modified_base (199)..(199): a, c, t, g, unknown or other
  modified_base (277)..(277): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccattcttccgtgtctgcatctggtagganacagagtcaaccatcacttggtcgggcgagtcagggtattagcaagtggttgctgtatcagacggaaacagggaaacncccctaaactcctagatctatgaagcatccgtagtttgactaaaggtcggggtacccagtacccgtaaagggttcaaggcggacgtaggtggatcggtaggggacagtactttcactctacacctatacagcacgcctgcagtacctagaagtatttcgaactaactttactactagtaacaacgaggtactaactacgtttacctaatccgtacccgttacggacccgtaaaggggaccctaaacggacgtaagggtaaacgtaaacgttaaaaccggtaacgtggttacggaccgtacgtacccaaccctatttcccg

SEQ ID NO: 432729 - DNA, 590 bp, Homo sapiens
  misc_feature: GZ8MTXP02GMIDD.4.82.H05.1.454.CMB.2.raw
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctggaggtgaagaagccgtggggcctcgagtgagtggtctccgtgacgaggtcttcgtggtacttccacccttcaccggtctacttatttcgctacgtggtcgcgacgacggccccgtggacgagggtcttggagtggagtgggatggactacaaaccttagtaggtacgggtcgaccacacgtactagtcgacaactacgttacgttttcggtgggacgtacgggtacccacgtacgacggaaccgaacgggaccacgtaccagtaccgacgcaccgacgtccctaacgagtaggtacgcgtaggacgacggtaacggtcgtagaaggacttacggacggacgaccgacgggtaccgttaagtaacttcgtggttcgtcgtgttaggtagg

SEQ ID NO: 432730 - DNA, 591 bp, Homo sapiens
  misc_feature: GZ8MTXP02I5382.4.82.H05.1.454.CMB.2.raw
  modified_base (441)..(441): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcgagggtattagcaaggtggtggcctggtatcagacaagaaaccgagggaaacgcccctaaactcctagatctatgaagctatcctagtttcgacgtaaaggtcggggtacccagtacgtaaggttcaggtcggacgaggtggatcggtaggggactagtactttcactcctacaacctatacgagcacgtccctgaccacgcctagtaaagttnttttacgaccttaacttactactacgtacaacgtacgtactaactaccgtttacctactaccgtaccgttcggaccgtaaacgggacaacggtacgtaggaacgtaaacgttaaacggactacggtacggtactacgacctaaccgtacg

SEQ ID NO: 432731 - DNA, 556 bp, Homo sapiens
  misc_feature: GZ8MTXP02G8Z92.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcaaggtggttggcctggtatcgagcaagaaaccgagggaaacgacccctaaactcctgatctatgaagcatcctagtttcgacgtaaaggtcggggtaccatcgaaggttcaggcggacaggtggatcgagggactagtactttcactctcacccatcagcacgccctgcacgacctagaaagttattttagacctaactttactactgtaccaagacgtactaaactcgtttaccctattcccgtaaccgttcggacctaaacgggaccacgacgtacggaacgtaaattaaacgacgtagtcggactcgaccactac

SEQ ID NO: 432732 - DNA, 518 bp, Homo sapiens
  misc_feature: GZ8MTXP02IWL4S.4.82.H05.1.454.CMB.2.raw
  modified_base (264)..(264): a, c, t, g, unknown or other
  modified_base (283)..(283): a, c, t, g, unknown or other
  modified_base (366)..(366): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctgggctgaggtgaagaagccgtggggcctcagtgatggtctctgcaaggcttctgattcaccttcaccggntactatttgcacgtgggtncgacacggcccctggacgaggcttgagtggatggatggatcaacctatagtgtgccacacactatgacactagtacttttcgngggcagggtcacatcgacagggacaccgtacacgcaagcaacgacgacctacgagtagggagcgtaggagcgacggacgtagagtacgtacgtacggacgaccgaccggtacggttaacgttacgttacgttcgttgttcgttcgttggtag

SEQ ID NO: 432733 - DNA, 550 bp, Homo sapiens
  misc_feature: GZ8MTXP02F4Z2L.4.82.H05.1.454.CMB.2.raw
  modified_base (197)..(197): a, c, t, g, unknown or other
  modified_base (246)..(246): a, c, t, g, unknown or other
  modified_base (265)..(265): a, c, t, g, unknown or other
  modified_base (287)..(287): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcacatcattgtcggcagtcaggtatagcagtggtgctggtancagcagaaacagggaaacncccctaaactcctagatactanagaagcatcctaggtttgacgtaaaggtcggggtacccagtacgtaaggttcaaggcggacgaggtgggactcggtagggaactagtactttcacttctaccaccatcagctagcctcgcagcctagaaacgttatttacgaccttaactttactacgtactaccaaagtcggtacttaacgtctttaccctatcctacgttacggacgaaacggacacgactaggaactaagtaaacgactacggcggtactacgccaactc

SEQ ID NO: 432734 - DNA, 533 bp, Homo sapiens
  misc_feature: GZ8MTXP02IMG6M.4.82.H05.1.454.CMB.2.raw
  modified_base (384)..(384): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctggaggtgaagaagccgtggggcctcagtgatggtctctgcaaggcttctggtattcaccttcaccggctactatttgctacgtgggtgcgacacggcccctggacgaagggtcttggagtgagtgggatggatcaacctattagttgtcgaccacacacgtatcgactacgtacgtactttcgngggactacggggtccacgagtacgaacccgagggacctacggtaccatcgacgacaacacggaccctagagtggacgtcgtgacgcgaacgtcgagagtctacgacgaccgacgacggtccgtaagttaactcgtgtgtcgtcgtgtag

SEQ ID NO: 432735 - DNA, 544 bp, Homo sapiens
  misc_feature: GZ8MTXP02GG4X5.4.82.H05.1.454.CMB.2.raw
  modified_base (395)..(395): a, c, t, g, unknown or other
tcagagcactgtagcacgaccggtgctcgatttagtcgagctctctcgcgggggagagcatcacccagcaaccacatctgtcctctagagaatccccctgagagctccgttcctcaccatggactggacctggaggatcctcttcttggtggcagcagccacaggagcccactcccaggtgcagctgatgcagtctggggctgaggtgaagaagccgtggggcctcgaggtgatggtctcctgcaaggcttcgtggattcaccttcaccggtctactatttgctacgtgggtgcgacacggcccctggacgaagggtcttaggagtgggagtggggatggatacaaaccttagtaggtggtcgacccaacactactatgacacagtacttttcgngggtcagggtcacgagtacgaccgagggacacgtccatacgacgaccacacgacctaacgagtaggacgctaggacgcgaaggtcgaggagacgttacgacgaacggaccgaccggtcgtaagttacgttacgtgtcgtcgtcgtgtag

SEQ ID NO: 432736 - DNA, 514 bp, Homo sapiens
  misc_feature: GZ8MTXP02JC5W4.4.82.H05.1.454.CMB.2.raw
  modified_base (219)..(219): a, c, t, g, unknown or other
  modified_base (363)..(363): a, c, t, g, unknown or other
  modified_base (380)..(380): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctgggctgaggtgaagagctgggcctnagtgatggtctctgcaggctctggattcaccttcaccggctactatttgcacgtgggtgcgacacggcccctggacaagggcttgagtggatggatggatcaaacctatagtggtgccacacataatgacacagtacttttcgngggcagggtccaaccgntacgaaccgagggaccacggtacccatcacgcacagaccctagatggagctagacgcgaggtcaggaagactcgtacggaccgaccgaaccggtccgtaagttacgttactcggttgtcgtttcgtaggttagg

SEQ ID NO: 432737 - DNA, 564 bp, Homo sapiens
  misc_feature: GZ8MTXP02G7MB8.4.82.H05.1.454.CMB.2.raw
  modified_base (226)..(226): a, c, t, g, unknown or other
  modified_base (357)..(357): a, c, t, g, unknown or other
  modified_base (402)..(402): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaaggagacagagtcaaccatcacttggtccgggnaagtcaggggtattagcaaggtggtggcctggtatcagacaagaaacaggggaaacacccctaaactcctgaatctaatgaagcaatccaagtttgacgaaaggtggggtccatacgaaaggttcagcggnaaggtggatgtagggaactaggtatttcaacttctacaacccaanacacgacacgactacgacacgacgtagtaagtagttagtacgtaacttactactagtacaacgacgtactaactacttacctactactaccgtacgacgaacggaacgaacgacgacgtaagaaagtaaaacgtaacgtacgtacgtacgtacgacaactac

SEQ ID NO: 432738 - DNA, 558 bp, Homo sapiens
  misc_feature: GZ8MTXP02G6WN3.4.82.H05.1.454.CMB.2.raw
  modified_base (408)..(408): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcagggtattagcaagtggtggcctggtatcagcagaaaccagggaaagcccctaaactcctgatctatgaagcatcctagtttgactaaaaggtcggggtacccatcgaaaggttcaaggtcggcagtggatcgtggggacagatttcactctcaccatcagcagcctgcagcctagaaagtnttttagactaacttactactagtacaacgaggactaaactagtttaccctattcctaacccgtttcggaaccaaacgggggaacaccggtaacgttacggaaacggtaacttaaaaccgaacttaggtacggtacgtcggacctacctac

SEQ ID NO: 432739 - DNA, 531 bp, Homo sapiens
  misc_feature: GZ8MTXP02I7HJJ.4.82.H05.1.454.CMB.2.raw
  modified_base (197)..(197): a, c, t, g, unknown or other
  modified_base (392)..(392): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcagggtatagcaagtggtgctggtatcagcagaaaccaggaaacgcccctaaactcctgatctatgaagcatccagtttgacaaagtggggtccatcgaagttcagcgcagtggatcgtggacagtatttcactctcaccatcagcagcctgcagacctgaaagtnttttgactaacttactactagtacaacgaggactaaactacgtttaccctattcctaccgttcggaccgaacgggaccaacggtaccgtaggaagtaaacgttaaaacgacgttaggtacggacttacgaccactaacg

SEQ ID NO: 432740 - DNA, 567 bp, Homo sapiens
  misc_feature: GZ8MTXP02FTSHM.4.82.H05.1.454.CMB.2.raw
  modified_base (224)..(224): a, c, t, g, unknown or other
  modified_base (384)..(384): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagccgtggggcctnagtgatggtctctgcaaggcttctggattcaccttcaccggctactatttgcacgtgggtgcgacacggtcccctggaacgagggcttggagtggagtggggatggactacaaacccttaagtaggtggtcgccacacactatgcactagtacttttcgngggacgtagggtccaccgagtcgaaccgagggaccacgtaccacgtcaacgcacgacgaccctaacgacgtagggaacgtcgtaggacggccgaagggtccgtaggaagtacgttacgtacggaccggaaccgaccgggtaccgttaagttaacgttacgtggttcggttcgtcgttggtaag

SEQ ID NO: 432741 - DNA, 545 bp, Homo sapiens
  misc_feature: GZ8MTXP02HA0A7.4.82.H05.1.454.CMB.2.raw
  modified_base (382)..(382): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcaagtggtggctggtatcagcagaaaccagggaaacgcccctaaactcctagatctatgaagcatccagtttgactaaaggtcggggtacccagtacgaaggttcaggcggcaggtggatcgtgggacagtatttcactctcaccntcagcagcctgcagcctagaagtatttacgacttaacttactacttagtaccaacgacggtaccttaactacgtttaccctattccctaccgttccggaccgaaacgggaccacggtacgtaggaactaaacgttaaacgacgtagtcggactcgaccactac

SEQ ID NO: 432742 - DNA, 527 bp, Homo sapiens
  misc_feature: GZ8MTXP02GX7VX.4.82.H05.1.454.CMB.2.raw
  modified_base (244)..(244): a, c, t, g, unknown or other
  modified_base (364)..(364): a, c, t, g, unknown or other
  modified_base (400)..(400): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcggcagtcaggtatagcagtgtgctgancagcagaacaggaacgcccctaaactcctgactctatgaagcatccagtttgacgaagtgggtccatacaagttcagcgcagtgatcgtgggacagtactttcactctcaccatcagcancctgcagcctagaagtatttgactacttactacgtntacaacgtagacttaacgatttacccctatccgtaacctttcggaacctaaacgggaccaacggtaccgttagggacctaaagttaaaaccgaagttacggttcggacctaggacccaaccgttaac

SEQ ID NO: 432743 - DNA, 618 bp, Homo sapiens
  misc_feature: GZ8MTXP02FQ1VN.4.82.H05.1.454.CMB.2.raw
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtcgtggggctggaggtagaagaacgccgtggggcctcgagtgatcggtctccgtgcgaaggtctttcgtggtacttccgtacccttccgaccggtcttaacttatttcgcacgttgggtcgaccggaaccgacgggtcccccgtaggaacgtaaggggtcgtttaggaggtgggaagtggggaacgtacgggtacttaccgaaaacccttaaggttacggtggtaccgaccaacctaacactagtacgacaacgtacgttacttttcggagggactacgggtccacgtacgtacgaaccgagggaccacggtaccatacgacgacacgacgactacgagtacggagtcgagaacgcgagcgtaggacgtactacgacgacgacggtacggtccgtaagttacgtacgttggtgttcgtgttagtagg

SEQ ID NO: 432744 - DNA, 570 bp, Homo sapiens
  misc_feature: GZ8MTXP02FM76Y.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtcctccatcttccgtgtctgcatctgtaggagacagagtcaccatcacttggtcgggcgagtcgagggtattagcaagtggtggctggtatcagcagaaaccagggaaacgcccctaaactcctgatctatgaagcatccagtttgacgtaaaggtcgggtacccatacgaaggttcaggcggcaggtggatcgtagggactagtactttcacttctcacctatcagctacgcctagcagtcctagtagttatttacgactaatttacacttacgactaaacgacggtaacttaactacgtttaccctacttaccgtaccgtacggtaccgaaacgggacctacgtacgtaacggaactaaacgttaaaacggtacgtggtacggcttacgacctacgttaacg

SEQ ID NO: 432745 - DNA, 578 bp, Homo sapiens
  misc_feature: GZ8MTXP02GJGTM.4.82.H05.1.454.CMB.2.raw
  modified_base (253)..(253): a, c, t, g, unknown or other
  modified_base (390)..(390): a, c, t, g, unknown or other
tcagagcactgtagcacgaccggtgctcgatttagtcgagctctctcgcggggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcggcgagtcagggtatagcaagtggtggctgtancagcaagaaacgaggaaacgcccctaaactcctgatctatgaagcatcctagtttgacgaaaggtcggggtaccatacgaaggtcagcggcaggtgggatcgtagggactagtactttcacctctaccaaccatcancgacgcctgacacgacccgtaagtatttacgaccttaaactttactacttacgtacaaaccgaggtaccttaactacgtttaccctactaccctaaccgttaccggaccgaaacgggaccacggaacgttagggaaactaaacgttaaaacgaacgttacggtacggtactacgacaacctacttccg

SEQ ID NO: 432746 - DNA, 664 bp, Homo sapiens
  misc_feature: GZ8MTXP02HOIK7.4.82.H05.1.454.CMB.2.raw
  modified_base (408)..(408): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagccccactcccaggtgcagctgatgcagtctggggctggaggtgaagaagccgtggggcctcgagtgagtggtcctcgtgcaaggcttcgtggacttcaccttcgaccggtcttactatttgctacgtgggtgcgacgacggcccctaggacaaggggcttggagtggagtggggacttggactacgaaaccttagtaggtggtcgaccaacgtacactatgaccacgtacgtacgtttttcgngggtcgacgggttcaaccgtacgtcggaacccgacggggacctaccggtaccctaataccgaacggtaccaacggaccggaaccccttaacgaacggttaccggggaagtcggtacggaacggccgtacgggggacttaggaaacggtacgtttacccggacgggaacccggaaccggtaacccggggtcgtttaacggtttaacgtttaaccggtttcgggttaggtttccggttacggtttagggtttaacggg

SEQ ID NO: 432747 - DNA, 559 bp, Homo sapiens
  misc_feature: GZ8MTXP02HSPMH.4.82.H05.1.454.CMB.2.raw
  modified_base (456)..(456): a, c, t, g, unknown or other
  modified_base (476)..(476): a, c, t, g, unknown or other
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggacgcccactcccaggtgcagctgatgcagtcgtggggctggaggtgaagaacgccgtggggcctcgagtgagtggtcctctgcaaggtcttcgtggacttccaccttcaccggtctactatttgctacgtgggtgaccgacgacggccccgtaggacgagggtctaggaggtggagtggggactagggtactacgtaaacccttagtacggtggtccgaccacaactactatcgacacgacgttactttcgtgggactcggtacaccgtagtcgaacgacggtacacgtacanacacgcacacgaccctaagngtaggagctagacgcgagcgtagagtactcacggacgacgaaccggtctaaggttcttacgtggtcgttagtcgtttagtagg

SEQ ID NO: 432748 - DNA, 741 bp, Homo sapiens
  misc_feature: GZ8MTXP02I0F6P.4.82.H05.1.454.CMB.2.raw
  modified_base (197)..(197): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtccgggcgagtcgagggtattagcaaggtggtgctggtatcagcaagaaaccgagggaaacgcccctaaactcctagatctatgaagcatccgtagtttgacgtaaaggtcggggtacccagtacgaaggttcacggcggccagggtggtatcggtggggactaggtactttaccgaacttcctaccaccatacgacgacgtacgtcccgtagaccgacggtcccgttaagtaaaggtttaacgtttttacggaaacctttaaaaccgtttacccttaaccgtttacgggaaaccctaaaccgtaaacgggttccctttaaaaacccgttccgggttttttaacccccaaacgtttaccccgtaaccccggtttacccgggggaaaaccccgttaacgggggaaaaccctaaccggggttaaaacgggtttaccgggaaaacggttaaaaccgtttaaaaccggtacccggttaaagggtttaccggggcctttaaccggggacccttaaaaccccggtttacg

SEQ ID NO: 432749 - DNA, 802 bp, Homo sapiens
  misc_feature: GZ8MTXP02FOLS4.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatccttccgtgtctgcatctgtaggagacagagtcaccatctacgttggtcggcgtagtcgaggggttattaaggcgtaaggtggttggccgtaggtatccgagacgaacggaaaccgtaagggaaaccgtacccctaaaactccgtagtactactaagtgaaaactcgaactcccgtaaggtttacgaccgtaaaaggggttccggggtacccctaagttaccgtaaacgggtttccaaacggccgggtacgagggttcgggtacttaccggggtagggaaaccgtaggttaactttttaccacccgtttacctaacccgaaaccccttaactaccgtaacggaccctacccggtcccgtacggaaccgtaccgttaccgttaaggttaaacgtttacgtttaaccgaaaccctttaaaccgtttaccgttaacgttaaccgtaaaccgtaaaaccggtaccgttaaaccctttaaaccggtttacccgtttaacccctacgtaacccgtaacccgtacccgggaaacccggtaaacgggtaaaccgtaaccggtaaccggtaaacggtaacgttaaaaccgttaaaacggtacgtaacggtaccggtacgtaccgtaccctaacctacg

SEQ ID NO: 432750 - DNA, 571 bp, Homo sapiens
  misc_feature: GZ8MTXP02FPDQO.4.82.H05.1.454.CMB.2.raw
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggcgggcagtcaggggttattagcaagtggttggcctggtatcagcaagaaaccagggaaacacccctaaactcctgatctatagaagcatccagtttgacgaaggtcggggtaccatcgaaggttcaggcggacagttggatcgtaggggacagtactttcactctcaccatcgagcagcctgactagacctagtaaagttattttacgacttaacctttactacgttacgtacaaacgtacggtaacttaacttacgtttaccctattaccgtaccgttaccggacctaaacggggaccaccgtacgacggactaaagtaaaccgtacgttaggtacggctacgactaccttac

SEQ ID NO: 432751 - DNA, 567 bp, Homo sapiens
  misc_feature: GZ8MTXP02FGSX4.4.82.H05.1.454.CMB.2.raw
tcagagcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagccgtggggcctcagtgagtggtctcctgcaaggtcttctggattcaccttcaccggtctaactatttgctacgtgggtgcgacacggcccctggaccgaagggcttggagtggagtggggactggactaccaaacccttaagtacggtggtcgcccaacactacgtatggacacgtacgttaaccgtttttcgtggggtacgtacgggtccaacccgagtacggaaacccgaggggaacctaccggtaccaagccaagaccaacacgacctaacgagtggagtccaggacgcgacggcgtaggagtacgtccagaaccgacgaccggaccgtgtattacgtgtgtcgtctggtag

SEQ ID NO: 432752 - DNA, 670 bp, Homo sapiens
  misc_feature: GZ8MTXP02IXN01.4.82.H05.1.454.CMB.2.raw
  modified_base (281)..(281): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtccgggcagtcagggtattagcaaggtggttggctggtatcagcaacgaaaccgagggaaaccncccctaaatcctagactctagtagaagctactccgtagtttcgacgtaaaggtcgggtaccacgtacgtaaggttcgaagtcggacgtagtggatcgtagggactagtactttcacctctacaccatcgacgcacgtcctagactacgaccgtagttaaacgttacgtttttacgaaccttaactttaccgttaccgtacgttaacccgaaacgtacggttaaccttaaaacgttccgttttacccctaagttccccgtaaacccggttccgggtaaacccgtaaacggggtaacctacgggtaaacgttaacggggtaaacttaaaacggttaaaaccggtaacggtttacggtaccgggtacttaccggaactaccccggtttaacg

SEQ ID NO: 432753 - DNA, 615 bp, Homo sapiens
  misc_feature: GZ8MTXP02GACJ4.4.82.H05.1.454.CMB.2.raw
  modified_base (250)..(250): a, c, t, g, unknown or other
  modified_base (270)..(270): a, c, t, g, unknown or other
  modified_base (295)..(295): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcattgcggcgagtcagggtatagcaaggtggtgctggtancagcaagaaaccaggaaacncccctaaactctagatctatagaancatcctagtttgacgaaaggtgggtaccagtactaggtcagcggacaggtggactcgtagggacagtactttcactcctacacccatacagctagccctagcaacgtaccgtagtaaagttattttacgaacttaaactttacctaacgttacgtaaacctaaaccgtacggtaaacccttaaacgttacgtttaccccttaacgttaccctaacccggtttaccgggaaacccggtaaacgggaacctaaccggtacgttaagggaacgtaaaacgtaaaacggtaacgtcggtacggacttacgacctaaccttaacg

SEQ ID NO: 432754 - DNA, 518 bp, Homo sapiens
  misc_feature: GZ8MTXP02FL0H4.4.82.H05.1.454.CMB.2.raw
  modified_base (421)..(421): a, c, t, g, unknown or other
tcagagcactgtagcacgaccggtgctcgatttagtcgagctctctcgcggggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcaagtggtggctggtatcagcagaaaccagggaaagccccctaaactcctgatctatgaagcatccagtttgcaaagtggggtccatcaaggttcagcggcagtggatctgggacagatttcactctcaccatcagcagcctgcagcctagaagtattttgactaacttactactgtacaanaggactaacacgtttaccctatacctaccgttacggaccgtaaacgggacaacgacgtaggagtaacttaaaacgacttgtacggctgaccacctac

SEQ ID NO: 432755 - DNA, 562 bp, Homo sapiens
  misc_feature: GZ8MTXP02G703R.4.82.H05.1.454.CMB.2.raw
  modified_base (198)..(198): a, c, t, g, unknown or other
  modified_base (397)..(397): a, c, t, g, unknown or other
  modified_base (410)..(410): a, c, t, g, unknown or other
tcagagcactgtagcacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccattcttccgtgtctgcatctgtagganacagagtcaccatcacttggcgggcagtcgagggtattagctaaggtggtggcctggtatcgagacaagaaaccgaggaaacacccctaaactcctagatctatgaacgctaatcctagtttcgacgtaaaggtcgggtaccagtacgaaggtcagtcggcaggtggactgtacggatagtacttcactctacacctanacgagcgacgcgngacgacgtctaagtattctttacactaacttactactagaactaacgtacgtacttaacgttaccgttacctactaccgtaccgtacgaacgaaacggtacaacggtacgtacgaacgtaaacgttaacgacgtcgtacgcacgactactcg

SEQ ID NO: 432756 - DNA, 663 bp, Homo sapiens
  misc_feature: GZ8MTXP02IE6MH.4.82.H05.1.454.CMB.2.raw
  modified_base (179)..(179): a, c, t, g, unknown or other
  modified_base (467)..(467): a, c, t, g, unknown or other
  modified_base (552)..(552): a, c, t, g, unknown or other
tcagagcactgtagcacgaccggtgctcgatttagtcgagctctctcgcggggagagcatcacccagcaaccacatctgtcctctagagaatccccctgagagctccgttcctcaccatggactggacctggaggatcctcttcttggtggtagcagccacaggagccactcccaggtncagctgatgcagtcgtggggctggaggtgaaagaacggccgtgggggcctcgagtgatggtctccgtgcaaggtcttcgtggaacttcaccttcgaccggtctacttatttgcacgtggggtcgacgacgacggccccgtagggaacgtaacggggtctttagggagtcgggtaagtgggggtattaggggaattaacccgtaaacccgttaaaaggtaggtttcggggtacacccgaactaaaccactttaaacgtcggaaccacgttaacggttaactttttcggnggggttacccgaacggggttacaaacccgtagtacgaacggacggggacaccgtaccaagttccacggacaacgacgttacaacngtaggagacgtgagccgaagcgtagaagttgacctaggaaccggaaccgtacggtaccgttacggttaaacgtttcgttaggttcgtcggtttcgtacggttacggtaagg

SEQ ID NO: 432757 - DNA, 525 bp, Homo sapiens
  misc_feature: GZ8MTXP01DIJYT.4.57.F02.1.454.CMB.2.raw
  modified_base (442)..(442): a, c, t, g, unknown or other
tcagagcactgtagcacgaccggtgctcgatttagctcgatatagttgggtttgggggaagaggaagactgacggtcctcccaggagttcaggtgctgggcaccgtgggcatggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaaactaacaaattctatgcagactccgtgaaggccgattcaccatctccagagacaatttcgagaacacattgaatctaacagatgaacagtctgagaagccgaaggacacgggctgtctattatgtgcgagagtaagtggtcatggtctttgaccagtgggccagggacctggtcaccgtctcctcngcttaccaccaaggcccatccggtcttccccgcggccgcccgtcgccttccgcggacgcacctcgtcggggcacgcgcgcccg

SEQ ID NO: 432758 - DNA, 563 bp, Homo sapiens
  misc_feature: GZ8MTXP01EMWXI.4.57.F02.1.454.CMB.2.raw
  modified_base (530)..(530): a, c, t, g, unknown or other
tcagagcactgtagcacgaccggtgctcgatttagctcgatatagttgggtttgggggaagaggaagactgacggtcctcccaggtgtccagtgtcaggtgcacctggtggaggtcggggggaggcgtggtccagccgtgggggtccctgagactctcctgtgcagcgtctggattcgccttcagtgcctatggcatgcacgtgggtcccgccaggctccaggcaagggggctgggaatggggtggcagttatagttggtttgataggaaactaacaaattctatgcagactccgtgaagggccattcaccatctccagagacaatttcgagaacacattgaatctacagatgaaacagtctgaagagccgagacacggctgtctattatgtgcgagagtaagtgtacagttggtcctttgaccaggtgggccagggggaaccctgggtcaccgtctcctcacgccttccaccgaacgggccctagtccggtcccttccccgtggcccgccctcgccttccgacggaacnccgaacccgtcggcggggccaacgcggcccggg

SEQ ID NO: 432759 - DNA, 512 bp, Homo sapiens
  misc_feature: GZ8MTXP01ESBMT.4.57.F02.1.454.CMB.2.raw
  modified_base (348)..(348): a, c, t, g, unknown or other
  modified_base (409)..(409): a, c, t, g, unknown or other
  modified_base (422)..(422): a, c, t, g, unknown or other
  modified_base (440)..(440): a, c, t, g, unknown or other
  modified_base (485)..(485): a, c, t, g, unknown or other
  modified_base (489)..(489): a, c, t, g, unknown or other
tcagagcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccattcaccatctccagagacaatttcgagaacacatgaatctacagatgaacagtctgagagccgagacacggctgtctattatgtgcgagagtaagtggtcatggtccttttagaccngtggggccagggaaccctggtcaccgtctcctcagctcacaggcccatcgtctcccctgcncctgctcaggacncacctcgtcggggcacgngccggccctgggctcgccgttggtcacggctaccttcccgttacncgtnctcgtgcgcgggtcgttggaacg

SEQ ID NO: 432760 - DNA, 560 bp, Homo sapiens
  misc_feature: GZ8MTXP01BTALL.4.57.F02.1.454.CMB.2.raw
  modified_base (289)..(289): a, c, t, g, unknown or other
  modified_base (535)..(535): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagcaggccaggccctgtggtgtcgtcgtangatagcgaccggcctgagggactcccgtgagcgattctctggcctcaactcgtaggggaaaccaccgggcccaccctgacccatccgagcgaggggtcgaaaggccggggatggacggccgaacttattacgtgtacagggtgtaggggataggggtagtggtgatcatcccaagttaccgtcttcgggaacgtgggaaccaagggtccttccgtccttacggtcacgcccgaaggcccaaccccntcgtcacttcctcgttcccgtcccc

SEQ ID NO: 432761 - DNA, 530 bp, Homo sapiens
  misc_feature: GZ8MTXP01CMMPM.4.57.F02.1.454.CMB.2.raw
  modified_base (505)..(505): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccaggggcagacggccaggataacctgtgtgggaaccagcatcggaaggtaaaagtgtacattggtacaggcagaagccaggccaggcccctggtggtggtcgtccgttatgatagcgacccggccctcagggatccctgagcgattctctcggctcaactctagggaaacacgggcccaccctgaccatcagcagggtcgaaggccggggatggaggccgactatactgtcaggtgtgggataggggtagtggtgatcatccatacgtcttggaactgggacaaggtcttccgtcttacgtcagcccaggcccaacccntcgtcacttctcgttcccctaaccc

SEQ ID NO: 432762 - DNA, 546 bp, Homo sapiens
  misc_feature: GZ8MTXP01EF6UP.4.57.F02.1.454.CMB.2.raw
  modified_base (360)..(360): a, c, t, g, unknown or other
  modified_base (415)..(415): a, c, t, g, unknown or other
  modified_base (522)..(522): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccaggggcagacggccaggataacctgtgtgggaaccagcatcgggaaggtaaaagtgtacattggtacaggcagaagccaggccaggccctgtggtggtcgtccgtatgatagcgaccggccctcgagggatccctgagcgattctctcggcttcaactcgtggggaaaacnccggccaccctgaccatcagcagggtcgaagccggggatgaggccgactattacngtcaggtgtagggattaggggtaggtggtcgatcatccatacgtcgttcggaacttcgggacctaaggtcttccgtccttacgtcacgcccgaaggcccaaaccccntcgtcacttctcgttccccaaccc

SEQ ID NO: 432763 - DNA, 525 bp, Homo sapiens
  misc_feature: GZ8MTXP01EB8NC.4.57.F02.1.454.CMB.2.raw
  modified_base (494)..(494): a, c, t, g, unknown or other
tcagagcactgtagcacgaccggtgctcgattagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaaactaacaaattctatgcagactccgtgaagggccgattcaccatctccagagacaaatttcgagaacacattgaatctaacagatcgaacagtctgagaagccgaaggacacggctgtctattattgtgcgagagtaagtggtctagtgttctttgaccagtgggcaggaaccgtgtcacgtctcctcagcttccacaacggccatcggtccttccccttggcccgcctcgcttccgngacgcacctcgtggggcacgcggccggcccg

SEQ ID NO: 432764 - DNA, 536 bp, Homo sapiens
  misc_feature: GZ8MTXP01CKINH.4.57.F02.1.454.CMB.2.raw
  modified_base (367)..(367): a, c, t, g, unknown or other
  modified_base (470)..(470): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagaagccaggccaggcccctgtggtggtcgtcgtatgatagcgaccggccctcgagggactcccgtgagcgtattccctcgtggctcccaactcgtagggaacnccgggccacccgtgaccatcagcgagggtcgaaggccggggatggaggccgactatacgtgtcgaggtgtgggggataggtagtggtgatcgatccatacgtnttacggatgggacagggtcttccgtctcgttcgcgcccaaggcccaactccacgttcgtcaactcc

SEQ ID NO: 432765 - DNA, 547 bp, Homo sapiens
  misc_feature: GZ8MTXP01AKEFT.4.57.F02.1.454.CMB.2.raw
  modified_base (356)..(356): a, c, t, g, unknown or other
  modified_base (494)..(494): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaggtaaagtgtacattggtacaggcagaagccaggccaggcccctgtggtgtcgtcgtatgatagcgaccggcctcgagggactccctgagcgattcctctggctcccaactcgtagggaacncgggcccaccctgaccatcagcgagggtcgaaggccggggatggacggccgtatacgttacgtgtcgagggtggtgggggattaggtagtcggtgatcgatcccgatccgtcgttccggaactgggaaccaaggtccnccgtcctacgttcgcgacccaaggcccaacgtccacgttcgtccttaactccg

SEQ ID NO: 432766 - DNA, 543 bp, Homo sapiens
  misc_feature: GZ8MTXP01CX7WK.4.57.F02.1.454.CMB.2.raw
  modified_base (477)..(477): a, c, t, g, unknown or other
  modified_base (490)..(490): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagagccaggccaggcccctgtggtggtcgtccgttatgatagcgaccggcctcagggatccctgagcgattctctcggctacaactcgtcgggaaacacgggccaccctgacccatcagcaggggtcaaggccggggatggaggccgactattactgtcaggtgtagggataggggtagtggtgatcatccatacgtctcggaactgggaccaaggtccncgtccttacgtcncgacccgaacggcccaaacccctacgtcgtccacttcgtcgttccccgtcccc

SEQ ID NO: 432767 - DNA, 600 bp, Homo sapiens
  misc_feature: GZ8MTXP01DV2Y5.4.57.F02.1.454.CMB.2.raw
  modified_base (448)..(448): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaaactaacaaattctatgcagactcgtgaaggccattcaccatctccagagacaattcgagaacacattgaatctacagatacgaacagtctgagaagccgaagacacggctgtactattatgtgcgagagtaagtgtcagtgttctttgaccgagtcgggacgacgggaaccgtggtccaccgtctccgtcncgtccttaccaaccgaacgggcccctacgttcccggtcccctttcccccggttcgggtccccgccccgttcggcccttaccccggagggaccgcccgtaacccgttccgggtccggggggccaaccgggtcggttccccgggggtccccggg

SEQ ID NO: 432768 - DNA, 651 bp, Homo sapiens
  misc_feature: GZ8MTXP01CTIOF.4.57.F02.1.454.CMB.2.raw
  modified_base (174)..(174): a, c, t, g, unknown or other
  modified_base (346)..(346): a, c, t, g, unknown or other
tcagagcactgtagcacgaccggtgctcgatttagctcgatataggttggggtttggggcctaaggaagcagcactggtggtgcctcagccatggcctggaccgttctcctcctcggcctcctctctcactgcacaggctctgtgacctcatatgtgctgactcagccaccctnagtgtcagtcggcccagggcagacggcaggataacctgtgtgggaaccagcagtacgggaagtaaagtgtactagttggacaggacagaacgccgaggccacggcccctggtcggtcggtcgttaccgttagtgaactaggccggtacccggcctacgacgggactttcccnggacgtcgtacttcgtcgtcggcctacaacgttcgacgggaaaaccaccggcccaccgtcgaacctacacgacggacgacggggacgaaacgggccggggaagcgggacggacccgtaattacgttaacgtgtagaggttggagggtaataggggttacggtggggttacactactacgtacgtagttaccgtcgtacggtacgtacgggtaacgtaacggtccgttccgtaccacgtacgacccgacccgaaccgacccctaacctcgttccgtcctaccgttccctcccgttccccgtaaccc

SEQ ID NO: 432769 - DNA, 550 bp, Homo sapiens
  misc_feature: GZ8MTXP01D12UQ.4.57.F02.1.454.CMB.2.raw
  modified_base (217)..(217): a, c, t, g, unknown or other
  modified_base (335)..(335): a, c, t, g, unknown or other
  modified_base (543)..(543): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgcaggatactgtgnggacagcatcggaaggtaaagtgtacattggtacaggcagaagccaggccaggcccctgtggtggtcgtccgttatgatagcgaccggccctgagggactcccgtgacgcgacttccncgtggcctccaactcgtagggaacacggcccaccctgaccatcgagcgagggtcgaaggccggggatggaggccgactagttacgtgtcgagggtggtagggggaataggtaggtggtcgatcataccataccgtcttacggaacgtcgggaaccaagggtccttccggtcctacgttcgacgcccaacggccaactccacttgtccncgttccc

SEQ ID NO: 432770 - DNA, 516 bp, Homo sapiens
  misc_feature: GZ8MTXP01BIY94.4.57.F02.1.454.CMB.2.raw
  modified_base (473)..(473): a, c, t, g, unknown or other
  modified_base (485)..(485): a, c, t, g, unknown or other
  modified_base (501)..(501): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggagcgtggtccagcctgggggtccctgagactctcctgtgcagcgtctggattcgccttcagtgcctatggcatgcactgggtccgccaggctccaggcaagggggctggaatgggtggcagttatatggtttgatggaactaaacaaattcatgcagactcgtgaacgggcgattcacatctcagagacaattcgaagaacactattggaatctaacagatgaaacagtactgagagccgaggaacacggctgttntattattgttgngaagagtaagtcggtnagtggttccgtttgg

SEQ ID NO: 432771 - DNA, 531 bp, Homo sapiens
  misc_feature: GZ8MTXP01EP47A.4.57.F02.1.454.CMB.2.raw
  modified_base (336)..(336): a, c, t, g, unknown or other
  modified_base (413)..(413): a, c, t, g, unknown or other
  modified_base (494)..(494): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattccnctggctccaactctgggaacacgggccaccctgacccatcagcagggtcgaagccggggatgaggccgactattacngtcaggtgtgggggataggtagtggtgatcatccatacgtctcggaactgggaccaagggtcttccggtcctacgttccgngccccaagggcccaaactcccacttcgtccaacttcc

SEQ ID NO: 432772 - DNA, 529 bp, Homo sapiens
  misc_feature: GZ8MTXP01EEVCC.4.57.F02.1.454.CMB.2.raw
  modified_base (335)..(335): a, c, t, g, unknown or other
  modified_base (356)..(356): a, c, t, g, unknown or other
  modified_base (495)..(495): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtgtcgtccgtatgatagcgaccggcctcagggactcccgtgagcgattccnctggctccaactctgggaacncggcccaccctgaccatcagcgagggtcgaaggccggggatggacggccgactatactgtcagggtgtgggggataggtagtggtgatcgatccatacgtcttcggaactgggacaagggtccttccgtcctacgttcncgcccaaggcccaactccattcgtccaacgttcc

SEQ ID NO: 432773 - DNA, 596 bp, Homo sapiens
  misc_feature: GZ8MTXP01D3YV5.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtggaggtcggggggaggcgtggtccagccgtggggggtccctgagactctcctgtgcagcgtctggattcgccttcagtgcctatggcatgcactgggtccgccaggctccaggcaaggggctggaatgggtgcagttatatggttgatggaactaacaaattctatgcagactcgtgaagggcatcacatctcagagacaatttcgaagaacacattgaatctaacagactagaaacagtctgaaagacgccggaagacgacggctagtcttattattgtgcgtagagtaagtgtactagtggttcctttgacctaggtgggccagggggaaccctggtccaccgtctcctcgacgtccttacccaaccgaacgggcccctacgttcccgggttcccttccccccgtggttcccgtccccgttcgcccttcccgacgggaacgcctaacccgttcgggtacgggggccctaacgcggtccccgggg

SEQ ID NO: 432774 - DNA, 547 bp, Homo sapiens
  misc_feature: GZ8MTXP01BUE2X.4.57.F02.1.454.CMB.2.raw
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccagcatcggaagtaaagtgtacattggtacaggcagaagccaggccaggcccctgtggtggtcgtccgttatgatagcgaccggcctcagggatccctgagcgattctctcggctcaactcgtggaaacacgggccaccctgaccatcagcgagggtacgagcggatggacggccgaatagttaccgtgtacaggtggtaggtataggggtaggtggtgatcagtccagttacgtctacggaagtcgggaacctaaggtccttccgtccacgtcgacgttacccgaggacccaacccgatccgtcacgttctccgttccctaacccc

SEQ ID NO: 432775 - DNA, 525 bp, Homo sapiens
  misc_feature: GZ8MTXP01AK7Z8.4.57.F02.1.454.CMB.2.raw
  modified_base (468)..(468): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgtatgatagcgaccggcctcagggatccctgagcgattctctcggctccaatctgggaaacacggccaccctgaccatcagcaggggtcgaaggccggggatggaggccgactattactgtcaggtgtgggatagggtagtggtgatcatccatacgtcttcggaactgggacaaggtcnccgtcacgtcacgcccgaaggcccaaccccactcgccacttcgtcgttccccaaccc

SEQ ID NO: 432776 - DNA, 576 bp, Homo sapiens
  misc_feature: GZ8MTXP01EO323.4.57.F02.1.454.CMB.2.raw
  modified_base (443)..(443): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataaccgtgtgtggaaccagcagtcgggaaggtaaaagtgtaacattggtacaggcagaagccaggccaggcccctgtggtggtcgtccgttatgataggccgaccggccctcgagggactcccgtgagcgattctcgtcggctcaactcgtacggggaaaaccaccgggcccaccctgaccctatccgaggcgaacggggtcgaaaggccggggatggacggcgtaactattacgngtcgaggtgtagggtataggggtagtggtagatcatccatacgtcgttacgaacgtggaccgaagtccttccgtccttacgtccacgacccgaacggccccaaaccctgtctcacttctccgttccccaaccc

SEQ ID NO: 432777 - DNA, 588 bp, Homo sapiens
  misc_feature: GZ8MTXP01BSLAE.4.57.F02.1.454.CMB.2.raw
  modified_base (357)..(357): a, c, t, g, unknown or other
  modified_base (558)..(558): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcgggaagtaaaagtgtacattggtacaagcagagcaggccaggccctgtggtgtcgtcgtatgatagcgacccggcctcgagggactcccgtgagcgattctctcggcctccaactctagggaaaccnccgggcccaccctgacccatcacgcgagggtacgaaggccggggatggacggcccgaattacgttacgtgtcgaggtgtagggtaattaggggtaggtggtgattcagtccagtacgtcgttacggaacgttcggggaacctaagggtccttacccggttacccttacgtaccgacggccccgaaagggccccaaaccccntcgtccaccttccttcgttcccctaacccc

SEQ ID NO: 432778 - DNA, 544 bp, Homo sapiens
  misc_feature: GZ8MTXP01DU10N.4.57.F02.1.454.CMB.2.raw
  modified_base (516)..(516): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacccttagtgtcagtggccccagggcagacggccaggataacctgtgtgggaaccagcatcggaaggtaaaagtgtacattggtacaggcagaagccaggccaggcccctgtggtggtcgtccgttatgatagcgaccggcctcagggatccctgagcgattctctggccctccaaactcgtagggaaccaaccgggcccaaccctgacccatcagcaggggtcaaggccggggatggaggccgatattactgtcaggtgtgggataggtaggtggtgatcatccatacgtcttcggaactgggaccaagggtctccgttctacgttcacgcccaaggcccaaccccgntcgtcactcttcgttccccaaccttccc

SEQ ID NO: 432779 - DNA, 513 bp, Homo sapiens
  misc_feature: GZ8MTXP01DZ7TP.4.57.F02.1.454.CMB.2.raw
  modified_base (312)..(312): a, c, t, g, unknown or other
  modified_base (333)..(333): a, c, t, g, unknown or other
  modified_base (406)..(406): a, c, t, g, unknown or other
  modified_base (415)..(415): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaaggtaaaatgtacattggtacaggcagaagccaggccaggcccctgtggtggtcgtccgtatgatagcgaccggcctnagggatccctgagcgattccnctggctccaactctgggaacacggccaccctgacccatcagcagggtcgaagccggggatgaggcgatatacngtcaggtgngggggatgtagtggtgatcatccatacgtcttcggaactgggaccaagggtcttccgtctacgttcgcgcccaaggccaactccacttgtcaacttcc

SEQ ID NO: 432780 - DNA, 534 bp, Homo sapiens
  misc_feature: GZ8MTXP01CRDLZ.4.57.F02.1.454.CMB.2.raw
  modified_base (414)..(414): a, c, t, g, unknown or other
  modified_base (490)..(490): a, c, t, g, unknown or other
  modified_base (508)..(508): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcgagggatccctgagcgattctctcggctcaactctgggaaaaccaccgggcccaccctgacccatcagcagggtcgaagccggggatgaggccgatattacngtcaggtgtgggataggggtagtggtgatcatccatacgtcttcggaactgggaccaaggtccttccgtcacgtcngcccgaggcccaaccccnctcgccacttcctcgttccccgtccc

SEQ ID NO: 432781 - DNA, 511 bp, Homo sapiens
  misc_feature: GZ8MTXP01DX1ZV.4.57.F02.1.454.CMB.2.raw
  modified_base (218)..(218): a, c, t, g, unknown or other
  modified_base (224)..(224): a, c, t, g, unknown or other
  modified_base (352)..(352): a, c, t, g, unknown or other
  modified_base (409)..(409): a, c, t, g, unknown or other
  modified_base (507)..(507): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacgccaggatacctgtgnggaccngcatcggaggtaaagtgtacattggtacaggcagaagccaggccaggcccctggtggtgtcgtccgtatgatagcgaccggcctcaggggatccctgagcgattcctctggctccaactctgggaacncggccaaccctgaccatcagcagggtcgaaggccggggatgacggccgtactatacngtcgagggtgtggggggataggtagtggtgatcatccatacgtcttcggaatgggacaggtcttcgtctacgttcgcgccaagccaacgcattcgtcnctcc

SEQ ID NO: 432782 - DNA, 606 bp, Homo sapiens
  misc_feature: GZ8MTXP01A2DOG.4.57.F02.1.454.CMB.2.raw
  modified_base (366)..(366): a, c, t, g, unknown or other
  modified_base (580)..(580): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcgggaaggtaaaagtgtacattggacaggcagaagccaggccaggccctggtggtggtcgtcgttatgatagcgaccggccctgagggactcccgtgagcgtattctcgtcggcctaccaacgtcgtagggaaaaccnccgggtcccaccctgacccatcaggcgaggggtccgaaaggcccgggggaatcgggacgggcccgtaacgttacgttacgtggtacgaggggttggtaggggtagttaaggggtaggtggtgatcgattcccgaagttaccggttcgttacgggaacgttcgggaacctaaggtccttccggtccttacgtcacgcccgaacggccccaacccntcgtccacttctccgttccccgcccc

SEQ ID NO: 432783 - DNA, 581 bp, Homo sapiens
  misc_feature: GZ8MTXP01CVBYG.4.57.F02.1.454.CMB.2.raw
  modified_base (368)..(368): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactcgtgaaggccgattcacatctccagagacaatttcgagaacacaattgaatctaacagatgaacagtctgagaagccgaaggacacgggntgtctattatgtgcgagagtaagtggtacagttggtccttttgacgtagtggggccagggaaccctggtccaccgttctcctcgacgtccttacccaccgtaaacgggccctaacgtcccggttcccttcccccgttgggtcccgcccgttcggccttacccgagggaccgtccacccgtcgtcgggggccacgtaaccggccggtccccggg

SEQ ID NO: 432784 - DNA, 546 bp, Homo sapiens
  misc_feature: GZ8MTXP01CECOQ.4.57.F02.1.454.CMB.2.raw
  modified_base (236)..(236): a, c, t, g, unknown or other
  modified_base (249)..(249): a, c, t, g, unknown or other
  modified_base (382)..(382): a, c, t, g, unknown or other
  modified_base (488)..(488): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgnagttatatggttnatggaaactaacaaattctatgcagactccgtgaaggccattcacatctccagagacaatttcgagaacacattgaatctaacagatcgaaacagtctgagaagccgaaggacacggctgtactattatgtgngagagtaagtggtcagttggtctttgaccagtcgggcagggaaccgtggtcaccgtctacctcacgcttaccaccgtaacgggccctacgtccggtcctttccccnggccgcccgttcgccttccgcggacgtccaccgtcgtcggggacacgcgcggtcccgg

SEQ ID NO: 432785 - DNA, 538 bp, Homo sapiens
  misc_feature: GZ8MTXP01DJ3E2.4.57.F02.1.454.CMB.2.raw
  modified_base (254)..(254): a, c, t, g, unknown or other
  modified_base (363)..(363): a, c, t, g, unknown or other
  modified_base (419)..(419): a, c, t, g, unknown or other
  modified_base (499)..(499): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcgaaggggctggaatggggtgcagttatagtggtttnatggaaactaacaaattctatgcagactccgtgaagggccgattcacatctccagagacaatttcgagaacacattgaatctaacagatgaacagtctagagaagccgnggacacgggctgtctattatgtgcgagtagtaagtggtcagttggttcctttgacngtgggacgacggaccgtgtcacgtctctcagctcacgtacggccatccggtctccccgttgccgttccgtcgccttccgnggacgctacccgtcgtcgggggcacgtcgccggtcccgg

SEQ ID NO: 432786 - DNA, 526 bp, Homo sapiens
  misc_feature: GZ8MTXP01A7Y84.4.57.F02.1.454.CMB.2.raw
  modified_base (338)..(338): a, c, t, g, unknown or other
  modified_base (441)..(441): a, c, t, g, unknown or other
  modified_base (493)..(493): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcagggatccctgagcgattccnctggctccaactctgggaacacgggccaccctgaccatcagcagggtcgaaggccggggatgaggccgatatactgtcaggtgtgggggataggtagtggtgntcatccatacgtcttcggaactgggaccaagggtccttccgtctacggttcncgcccaaggccaactccacttgtccaacgttcc

SEQ ID NO: 432787 - DNA, 521 bp, Homo sapiens
  misc_feature: GZ8MTXP01ARWVE.4.57.F02.1.454.CMB.2.raw
  modified_base (407)..(407): a, c, t, g, unknown or other
  modified_base (434)..(434): a, c, t, g, unknown or other
  modified_base (484)..(484): a, c, t, g, unknown or other
  modified_base (500)..(500): a, c, t, g, unknown or other
  modified_base (505)..(505): a, c, t, g, unknown or other
  modified_base (518)..(518): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggcctcagggactccctgagcgattctctcggctcaactctgggaaacacgggccaccctgaccatcagcagggtcgaagccggggatgaggccgactattacngtcgaggtgtgggatagggtagtggtnagtcatccatacgtctcggaactgggaccaaggtcttccggtcttcgtcngcccgagccaaccccntcgcncttctcgttcccnccc

SEQ ID NO: 432788 - DNA, 528 bp, Homo sapiens
  misc_feature: GZ8MTXP01DDEBW.4.57.F02.1.454.CMB.2.raw
  modified_base (415)..(415): a, c, t, g, unknown or other
  modified_base (496)..(496): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaagtgtacattggtacaggcagaagccaggccaggcccctgtggtggtcgtccgttatgatagcgaccggccctcgagggactcccgtgagcgattccctctggctccaactctagggaacacggccaccctgacccatcagcagggtcgaaggccgggatggagccgatatacngtcaggtgtgggggataggtagtggtgatcagtccatacgtcttcggaactgggaccaagggtccttccggtctacgttcncgcccgaagcccaactcccacttgtcaactcg

SEQ ID NO: 432789 - DNA, 527 bp, Homo sapiens
  misc_feature: GZ8MTXP01EHSL8.4.57.F02.1.454.CMB.2.raw
  modified_base (407)..(407): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggccaggataacctgtgtggaaccagcatcggaaggtaaaagtgtacattggtacaggcagaagccaggccaggcccctgtggtggtcgtccgttatgatagcgaccggccctcagggactccctgagcgattctctcggctcaactctgggaaacacggccaccctgaccatcagcagggtcgaagccggggatgaggccgactattacngtcaggtgtgggatagggtagtggtgatcatccatacgtcttcggaactgggaccaaggtcttccgtcttacgtcacgcccgaggcccaacccatcgtcacttctcgttcccctaacccc

SEQ ID NO: 432790 - DNA, 531 bp, Homo sapiens
  misc_feature: GZ8MTXP01DX933.4.57.F02.1.454.CMB.2.raw
  modified_base (312)..(312): a, c, t, g, unknown or other
  modified_base (413)..(413): a, c, t, g, unknown or other
  modified_base (453)..(453): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctnagggatccctgagcgattctctcggctcaactctagggaaacacggcccaccctgaacccatcagcgagggtcgaagccggggatggaggcgactattacngtcaggtgtgggatagggtagtggtgatcatccatacgtnttcggaactgggacaaggtcttcgtcttacgtcacgcccaggcccaacccactcgtcacttctcgttcccctaacccc

SEQ ID NO: 432791 - DNA, 553 bp, Homo sapiens
  misc_feature: GZ8MTXP01AHULQ.4.57.F02.1.454.CMB.2.raw
  modified_base (345)..(345): a, c, t, g, unknown or other
  modified_base (430)..(430): a, c, t, g, unknown or other
  modified_base (546)..(546): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagaagccaggccaggcccctggtggtggtcgtccgttatgatagcgaccggcctcgagggactcccgtgacgcgactttccnctggcctcccaactcgtagggaaccacgggcccaccctcgaccatcagcgagggtcgaaggccggggatggacggccgatatacngtcgaggtggtggggataggtgtggtgagtcagtcctagtcgtcgtacggaacgtcggggaccttaggtccttccgtcctacgttcgcgacccaaggcccaacgtccacttgtccncgttccc

SEQ ID NO: 432792 - DNA, 553 bp, Homo sapiens
  misc_feature: GZ8MTXP01B2KCB.4.57.F02.1.454.CMB.2.raw
  modified_base (225)..(225): a, c, t, g, unknown or other
  modified_base (335)..(335): a, c, t, g, unknown or other
  modified_base (430)..(430): a, c, t, g, unknown or other
  modified_base (447)..(447): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggcaggataacctgtgtggaaccngcagtcggaaggtaaaagtgtacattggtacaggcagaagccaggccaggcccctgtggtgtcgtccgttatgatagcgaccggcctcgagggatccctgagcgattccnctggcctccaactcgtagggaacacgggcccaccctgaccatcagcgaggggtacgaaaggccggggatggacggccgactatactgcagggtgnggggggatagtagtggngatcatccatacgtcttcggaacttggggaaccttaagggttccttccggtacctacgttccgacgaccccgaaggcccaaacttcccacttcgtccaacttcccg

SEQ ID NO: 432793 - DNA, 553 bp, Homo sapiens
  misc_feature: GZ8MTXP01DQVUQ.4.57.F02.1.454.CMB.2.raw
  modified_base (213)..(213): a, c, t, g, unknown or other
  modified_base (215)..(215): a, c, t, g, unknown or other
  modified_base (220)..(220): a, c, t, g, unknown or other
  modified_base (333)..(333): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacgcagataactgngnggacngcagtcggaaggtaaaagtgtacattggacaggcagaagccaggccaggcccctgtggtggtcgtcgttatgatagcgaccggccctcgagggactccctgacgcgtattccnctggcctaccaacgtcgtagggaacacggcccaccctgaccatcagcgagggtcgaaggccggggatggacggccgtaactattacgtgtcgagggttggtagggggtaataggtagtgggtagatcgatccaagtcgtcgttacggaacgtgggaccaagggtccttccggtcctacgttcgacgcccaaggcccaacgtcccattcgtcaacgttccg

SEQ ID NO: 432794 - DNA, 615 bp, Homo sapiens
  misc_feature: GZ8MTXP01EF4KQ.4.57.F02.1.454.CMB.2.raw
  modified_base (390)..(390): a, c, t, g, unknown or other
tcagagcactgtagcacgaccggtgctcgatttagctcgatatagttgggtttggggggaagaggaagactgacggtcctcccaggtgtccagtgtcaggtgcacctggtggaggtcggggggaggcgtggtccagccgtggggggtccctgagactctcctgtgcagcgtctggattcgccttcagtgcctatggcatgcacgtgggtccgccaggctccaggcaaggggctggaatgggtgcagttatatggttgatggaaactaacaaattctaatgcagactccgtgaagggccattcacatctcagagacaatttcgagaaacacattgaaatctaacagatgaaacagtctgaagagccgaagacacggctgtctattatgtgngagagtaaagtggtactattggttccttttgaccgtaggtcggggaccaggggggaaaccctgggtaccaccggtctcctcgacgtccttacccaaccgaaacggggccccaagttccgggttcccctttcccccgtcgggttcccgccccgttcggcccttcccgacgggaacgcccgtaacccgttccgggtcggggggacctaaccgaacgggtccccgggg

SEQ ID NO: 432795 - DNA, 603 bp, Homo sapiens
  misc_feature: GZ8MTXP01C5F58.4.57.F02.1.454.CMB.2.raw
  modified_base (309)..(309): a, c, t, g, unknown or other
  modified_base (347)..(347): a, c, t, g, unknown or other
  modified_base (411)..(411): a, c, t, g, unknown or other
  modified_base (447)..(447): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacgcaggataactgtgtggaacagcagtcggagtaaagtgtacagtggacaggcagaagcaggccaggccctgtggtgtcgtcgtatgatgcgaccggcctcgagggactcccgngacgcgtattctcgtcggctcaactcgacgggaaaccncggccacctgaacccatcagcgagggtcgaacggccggggaatggacggaccgacttattacgnggtcagggtgtagggtattagggggtagttgggganacgtacgtactacccgtattaaccggttcgttacgggaaaccgttcgggggaacctaaagggttcccttacccggtacttaccgtacgaaccgccccgaaacggccccaaacccctcgttcggccctaccgttccgttcccggttccccgtccccc

SEQ ID NO: 432796 - DNA, 591 bp, Homo sapiens
  misc_feature: GZ8MTXP01CW4Q8.4.57.F02.1.454.CMB.2.raw
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagcaggccaggcccctgtggtggtcgtccgttatgatagcgaccggccctcgagggatccctgagcgtattctctcggctaccaaacgtctacggggaaaaccaccgggcccaacccctgaacccactcgacgcgacggggtcgaaaggcccgggggaatgggaacgggcccggaactactttaactggtcgaagggtgtggggattaggggtagtgggtagatcgaatccagtaacgtcgttacggaacgtcgggaactaacgggtcttcccgtccacggtacacgacccgaggcccaacccgactcgtcacttctcgttcccctaacccc

SEQ ID NO: 432797 - DNA, 520 bp, Homo sapiens
  misc_feature: GZ8MTXP01EU22H.4.57.F02.1.454.CMB.2.raw
  modified_base (407)..(407): a, c, t, g, unknown or other
  modified_base (409)..(409): a, c, t, g, unknown or other
  modified_base (411)..(411): a, c, t, g, unknown or other
  modified_base (413)..(413): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtgcgtccgttatgatagcgaccggacccgtcagggagtccctcgagcgattctctggctcaactctggaaacgaacggcccacctacgaccatcagcagggcgaagcgggagtgagcgactatatgngngngngataggtagtgtgananancatactctcgtacgtacggacgaacgtacgttcgtcttcgtacacacgacgaccgaacccacctcgtcacttctccgttccgtaaccc

SEQ ID NO: 432798 - DNA, 587 bp, Homo sapiens
  misc_feature: GZ8MTXP01EO0XQ.4.57.F02.1.454.CMB.2.raw
  modified_base (449)..(449): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgcaggataacctgtgtggaaccagcatcggaaggtaaaagtgtacattggtacaggcagaagccaggccaggcccctggtggtggtcgtccgtatgatagcgaccggccctcgagggactccctgagcgattcctctcggctcccaaactcgtgggaacaccggcccaccctcgaccatcagcgaggggtcgaaacggccggggatcggacggaccgtaactacgttaacgtgtcgaagggttggnggggggtaattaagggtagtgggttagattcgaactacccgagttacgtcgttacggaacgtcggggaaccttaagggtccttccgtcctaacgttcgacgcccaaggcccaacgtccacttcgtccttaacgttccc

SEQ ID NO: 432799 - DNA, 587 bp, Homo sapiens
  misc_feature: GZ8MTXP01EU7WH.4.57.F02.1.454.CMB.2.raw
  modified_base (216)..(216): a, c, t, g, unknown or other
  modified_base (221)..(221): a, c, t, g, unknown or other
  modified_base (291)..(291): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccaggcagacgcaggatactgtgnggacngcatcggaggtaaagtgtacattggacaggcagaagccaggccaggcccctggtggtggtcgtccgttangatagcgaccggccctcgaggggactcccgtgagcgattccctcgtggcctacccaacgtcgtagggaaccaccgggcccacccgtgaacccatcagcgaggggtcgaaggccggggatggacgggccgtaatacgttacgtgtacgagggtggtaggggggattagggtaggtgggttagactcgatcccgtaagttaccgttcgttacgggaacgtcggggaaccttaagggtccttccgtcctacgttcgacgcccgaaggcccaaacgtccacgttcgtccttaacttcccg

SEQ ID NO: 432800 - DNA, 518 bp, Homo sapiens
  misc_feature: GZ8MTXP01DMV2Q.4.57.F02.1.454.CMB.2.raw
  modified_base (214)..(214): a, c, t, g, unknown or other
  modified_base (286)..(286): a, c, t, g, unknown or other
  modified_base (302)..(302): a, c, t, g, unknown or other
  modified_base (350)..(350): a, c, t, g, unknown or other
  modified_base (432)..(432): a, c, t, g, unknown or other
  modified_base (436)..(436): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccaggcagacgcagataactgtgnggacagcatcggaagtaaagtgtacattggacaggcagaagccaggccaggcccctgtggtgtcgtcgttangatagcgaccgccctnagggactccctgagcgatttcctctggctacccaactcgtagggaacncgggcccaccctgacccatcagcgaggggtcgaaggccggggatggaggccgatatactgcaggtgtgggggatagtagtgngatnagtccatagtctcggaactgggaccaaggtccttccgtctacgttcacgacccgaaggccaactccacttcgtcaacgttcc

SEQ ID NO: 432801 - DNA, 599 bp, Homo sapiens
  misc_feature: GZ8MTXP01A59AN.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatggggtggcagttatatggtttgatggaaactaacaaattctatgcagactcgtgaaggcatcacatctcagagactaatttcgagaacactattgaatctaacagatagaacagtctagagaagccgaagacacgggctgtactattagtgtgacgagagtaagtggtctagttggttccttttagaccgtaggtcggggaccgtaacggggaacccgttgggtacctaccggttctcccgtcgacgtccttacccgaaccgaaacgggtcccctacgtcccggttcccttcccccgttcggtcccgccccgtcgtccttaccgcggttacgcctaccgtcggtcgggggccacgcggcccggtcccgg

SEQ ID NO: 432802 - DNA, 580 bp, Homo sapiens
  misc_feature: GZ8MTXP01EQPO7.4.57.F02.1.454.CMB.2.raw
  modified_base (544)..(544): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaaactaacaaattctatgcagactcgtgaaggccattcaccatctccagagactaatttcgagaacacattgaatctaacagatcgaacagtctgagaacgccgaaggacacgggctgtactattatgtgcgagagtaagtgtctagtggttctttagaccgtaggtcggggaccaacggggtaacccgtggtccgtacccgttcctccctcgacgtccttacccaaccgtaacgggtcccctacgttcccggtcccttcccccgttggcccgcccgtcgtccttccgnggacgccaccgtcgcggggccacgcggccggtcccg

SEQ ID NO: 432803 - DNA, 574 bp, Homo sapiens
  misc_feature: GZ8MTXP01AT4VA.4.57.F02.1.454.CMB.2.raw
tcagagcactgtagcacgaccggtgctcgatttagctcgatatagttgggtttgggggaagaggaagactgacggtcctcccaggtgtccagtgtcaggtgcacctggtggagtcgggggaggcgtggtccagcctgggggtccctgagactctcctgtgcagcgtctggattcgccttcagtgcctatggcatgcactgggtccgccaggctccaggcaaggggctggaatgggtgcagttatatggtttgatggaactaacaaattcatgcagactcgtgaaggccattcacatctcagagacaatttcgagaacacattgaaatctacagatgaaacagtctgaagagccgaggacacgggctgtctattatgtgcgagagtaagtgtacagtggttctttgaccgaggtggggaccgagggggtaacccgtggtaccaccgttctcctcgacgtccttccacccgaaacgggcccctaacgtcccggttcccttcccccgtcggcccgccccgtcgcccgttccgacggaacgccgaacccgtcggtcgggggaccaaccgcggcccggg

SEQ ID NO: 432804 - DNA, 531 bp, Homo sapiens
  misc_feature: GZ8MTXP01BXRU0.4.57.F02.1.454.CMB.2.raw
  modified_base (227)..(227): a, c, t, g, unknown or other
  modified_base (360)..(360): a, c, t, g, unknown or other
  modified_base (417)..(417): a, c, t, g, unknown or other
  modified_base (426)..(426): a, c, t, g, unknown or other
  modified_base (524)..(524): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaggtaaaagtgtacattggacaggcagaagccaggccaggcccctggtggtggtcgtccgtatgatagcgaccggccctgagggactcccgtgagcgattccctctggctccaactctagggaacncgggccaccctgacccatcagcagggtcgaagccggggatggacggccgactatacngtcaggtgngggggatggtagtggtgatcatccatacgtcttcggaactgggaccaagggtcttccgtacctcgttcgcgccccaaggcccaactcccattcgtccncgttccg

SEQ ID NO: 432805 - DNA, 582 bp, Homo sapiens
  misc_feature: GZ8MTXP01BST9J.4.57.F02.1.454.CMB.2.raw
  modified_base (526)..(526): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggagcgtggtccagccgtgggggtccctgagactctcctgtgcagcgtctggattcgccttcagtgcctatggcatgcacgtgggtccgccaggcctccgaggcgaagggggctggaagtgggtgctagttatacgtgggtttagagtaggaaactaaaacgtaaattctaagtgacagacctccggtaggaacgggccgattcaccatctccagacgactaattacgaagtaacactattaggaatactaacagatagaactagtactaggagagcccgaaggaacgacggctgttcgttaattattggngttacggaaggtaggtaaggtggggttacttacggttcgggttccgttttaacggg

SEQ ID NO: 432806 - DNA, 515 bp, Homo sapiens
  misc_feature: GZ8MTXP01AY6BY.4.57.F02.1.454.CMB.2.raw
  modified_base (417)..(417): a, c, t, g, unknown or other
  modified_base (489)..(489): a, c, t, g, unknown or other
  modified_base (511)..(511): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaaggtaaaagtgtacattggtacaggcagaagccaggccaggcccctggtggtggtcgtcgtatgatagcgaccggccctcgagggactccctgagcgattccctctggctccaactctgggaacacggcccaccctgaccatcagcagggtcgaaggccggggatggacggccgatatacngtcaggtgtgggggataggtagtggtgatcatccatcgtctcggaatgggaccaggtccttccgtctacgcncgccaagccaactcacttgtcnctcc

SEQ ID NO: 432807 - DNA, 560 bp, Homo sapiens
  misc_feature: GZ8MTXP01DDOSA.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggttgatggaaactaacaaattctatgcagactccgtgaaggccattcacatctccagagactaatttcgagaacactattgaatctacagatacgaacagtctgagaacgccgaaggacacggcttgtactattatgtgcgagagtagtgtctatgttctttgacgtaggtcgggaccgacgggaccgtcggtctaccgtctcctcacgtcttacccaccgaacgggcccacgtccggtcccttccccgttggcccgttcccgtcgccttccgacggacgcctaccgtcggtcgggggcacgcggccggtcccgg

SEQ ID NO: 432808 - DNA, 539 bp, Homo sapiens
  misc_feature: GZ8MTXP01BPSWS.4.57.F02.1.454.CMB.2.raw
  modified_base (225)..(225): a, c, t, g, unknown or other
  modified_base (359)..(359): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccaggcagacggccaggataacctgtgtggaaccngcatcggaaggtaaaagtgtacattggtacaggcagaagccaggccaggcccctggtggtggtcgtccgttatgatagcgaccggccctcgagggatccctgagcgattcctctggctccaactctagggaacnccgggccaccctgaccatcagcagggtcgaaagccggggatggacggccatatactgtcagggtgtagggggattaggtgtgggtgatcatccatacgtcttacggaactggggaccaaagggtccttccgtacctacgttcgcgacccaaggcccaactcccacttgtccaacttcccg

SEQ ID NO: 432809 - DNA, 544 bp, Homo sapiens
  misc_feature: GZ8MTXP01EJ4CO.4.57.F02.1.454.CMB.2.raw
  modified_base (295)..(295): a, c, t, g, unknown or other
  modified_base (346)..(346): a, c, t, g, unknown or other
  modified_base (354)..(354): a, c, t, g, unknown or other
  modified_base (410)..(410): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacggcaggataacctgtgtaggaaccagcagtacgggaaggtaaaagtgtaacagttggtacaggcagaagccaggccaggccctgtggtggtctcgtangatagcgaccgcctgaggactccctgagcgattcgtctcggctcaactcgngggaaacncggccacctgaccatcagcgagggtacgaaggtcgggatgaggccgtaactattangtacgaggtgagggatagggtaggtgtgatcatccatacgtcgttcggaactcgggacctaagggtcttcccggtacttacgcacgacccgaaggccccaaccccatcggtccacgttctccgttccccaaccc

SEQ ID NO: 432810 - DNA, 564 bp, Homo sapiens
  misc_feature: GZ8MTXP01EA6IE.4.57.F02.1.454.CMB.2.raw
  modified_base (370)..(370): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcatcgggaaggtaaaagtgtacattggtacaggcagaagccaggccaggcccctggtggtggtcgtcgtatgatagcgaccggccctcgaggggatcccgtgagcgattccctcgtggcctccaactcgtaggggaaccnccgggcccacccgtgacccatcgagcgaggggtcgaaggccggggatggacggccgatatactgtcagggtgtgggggataggtagtggtgatcatccagtccgtcgttacggaacgtgggaccaagggttccttaccggtccgtaacgttccgacgcccgtaaggcccaactcccacttcgtccaacttcccg

SEQ ID NO: 432811 - DNA, 535 bp, Homo sapiens
  misc_feature: GZ8MTXP01AGZL1.4.57.F02.1.454.CMB.2.raw
  modified_base (333)..(333): a, c, t, g, unknown or other
  modified_base (354)..(354): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccagcagtcggaggtaaaagtgtacattggtacaggcagaagccaggccaggcccctgtggtggtcgtcgttatgataggcgaccggccctcagggatcccgtgagcgattcnctcggctcaactctggaaacncggccaccctgaccatcagcgagggtcgaaggccggggatggaggccgatattacgtgtcaggtgtgggatagggtagtggtgatcgatccgatacgtcttcggaactgggacaagggtcttccgtccttacgtcacgcccaagggcccaaccccatcgtcacttcctcgttcccaacccc

SEQ ID NO: 432812 - DNA, 790 bp, Homo sapiens
  misc_feature: GZ8MTXP01EC9TL.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacgcaggatactgtgtggaaccagcagtcggaaggtaaaagtgtacagttggtacaggcagaagccaggccaggcccctggtggtggtcgtcgttatgatagcgaccggcctcgagggactcccgtgacgcgtattcccgtcgtggcctacccaaacgttcgtacggggaacccgaccgggaccccaccccgttacggaacccctagtccgaacggccggaacgggggttaccggaaacggggcccgggggaattacggggaaccggggtacccgtaaacgtttaacgtttaaccggtgggttaccggtaagggggttacgggttacggggggggggtaaatttaaggggttaacgggttggggttaggaacgttcctaacgtttacccgtaaagtttacccgggttaccggtttaaccgggggaaaccggttaacgggggtaaaccccgttaaacgggggtttccccttaccccgggttacccgtttaaacccgggttacccgaaccgggttaccccccgaaaacggggtccccctaaaacccttccccgtaacgttccggttaaccccgttaaccgttttcccccggg

SEQ ID NO: 432813 - DNA, 567 bp, Homo sapiens
  misc_feature: GZ8MTXP01AKNSO.4.57.F02.1.454.CMB.2.raw
  modified_base (362)..(362): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtacgggaaggtaaaagtgtacattggtacaggcagaagccaggccaggcccctgtggtggtcgtccgtatgatagcgaccggccctcgagggactccctgagcgattctcgtcggctcaactcgtagggaaacncgggccaccctgaccatcagcgaggggtacgaaggccggggaatcggaacggccgaacttattacgtgtacgagggtgtaggggataggggtagtgggtgatcatccagtacgtcgttcggaacgtcgggacgtaaggtccttccgtccttacgtcacgcccgacggccccaacccactcgtcacttcctcggttccccgtcccc

SEQ ID NO: 432814 - DNA, 517 bp, Homo sapiens
  misc_feature: GZ8MTXP01AHPU9.4.57.F02.1.454.CMB.2.raw
  modified_base (487)..(487): a, c, t, g, unknown or other
  modified_base (513)..(513): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggactccctgagcgattccgctggctccaactctgggaacacggccaccctgaccatcagcagggtcgaaagccggggatggacggcgactatactgtcaggtgtgggggatagtagtgtgatcagtccatcgtcttcggatggggaccaaggtcttccgtcctacggcncgcccaaggccaacgtccacttgtcncttc

SEQ ID NO: 432815 - DNA, 566 bp, Homo sapiens
  misc_feature: GZ8MTXP01EC9GD.4.57.F02.1.454.CMB.2.raw
  modified_base (217)..(217): a, c, t, g, unknown or other
  modified_base (453)..(453): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtcggcccagggcagacgcaggatactgtgtggaaccngcagtcggaagtaaagtgtacattggtacaggcagaagccaggccaggcccctggtggtggtcgtccgttatgatagcgaccggccctcagggactcccgtgagcgattctctcggcctaccaactctagggaaaccacgggcccacccgtgacccatcgacgcgagggtcgaaggccggggatggacggccgaactattacgtgtacgagggtgtagggataggggtaggtggtnatcgatccgataccgtcgttacggaacgtcgggaaccaaaggtccttccggtccttacggtcacgcccgaacggcccaaccccacgtcgtcaccttctccgttccccgtcccc

SEQ ID NO: 432816 - DNA, 515 bp, Homo sapiens
  misc_feature: GZ8MTXP01A49HU.4.57.F02.1.454.CMB.2.raw
  modified_base (228)..(228): a, c, t, g, unknown or other
  modified_base (445)..(445): a, c, t, g, unknown or other
  modified_base (476)..(476): a, c, t, g, unknown or other
  modified_base (489)..(489): a, c, t, g, unknown or other
  modified_base (512)..(512): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccngcatcggaggtaaaagtgtacattggtacaggcagaagccaggccaggcccctgtggtggtcgtccgttatgatagcgaccggccctcagggatccctgagcgattcctctggctccaactctgggaacacggccaccctgaccatcagcagggtcgaaggccggggatggacggccacgtatacgtgtcaggtgtgggggataggtagtggtgatnatccatacgtcttcggaactgggacaggtcnccgtctacgttcngcccaaggccaactcacttgtcnctc

SEQ ID NO: 432817 - DNA, 677 bp, Homo sapiens
  misc_feature: GZ8MTXP01CWPP8.4.57.F02.1.454.CMB.2.raw
  modified_base (228)..(228): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctcagtgtcagtcggccccagggcagacggccaggataacctgtgtgggaaccngcagtcggaaggtaaaagtgtacagttggtacaggcagaagccaggccaggcccctgtggtggtcgtcgttatgatagcgaccggccctacgagggactcccgtgacgcgatttcctcgtggcctcccaaacgtccgtaggggaaccacgggcccaaccccgtgacccatcgagcgaggggtcgaaacggccgggggaatgggacggacccgtaacttaagttaccgtggtacgtaaggggttggtagggggggtaagttaggggttaaggtggggtaggtaacgtcgtaacgttccctaaagtttaccgtaccgttttaccggggaaaccgtttcgggggaaacccttaaacgggggttcccttcccggttacccgtaaccggttaccgaccgaccccgaaacgggtaccccaaaccgttcccaactttcggtccttaacctttcccg

SEQ ID NO: 432818 - DNA, 520 bp, Homo sapiens
  misc_feature: GZ8MTXP01EJAD8.4.57.F02.1.454.CMB.2.raw
  modified_base (352)..(352): a, c, t, g, unknown or other
  modified_base (407)..(407): a, c, t, g, unknown or other
  modified_base (489)..(489): a, c, t, g, unknown or other
  modified_base (514)..(514): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacgccaggataacctgtgtggaaccagcatcggaggtaaagtgtacatggtacaggcagaagccaggccaggcccctgtggtggtcgtccgttatgatagcgaccgcctcagggatccctgagcgattcctctggctccaactctcgggaacncggccaccctgaccatcagcagggtcgaagccggggatgaaggccgactagtacngtcagggtgtgggggataggtagtggtgatcgatccatacgtcttcggaactgggaccaagggtccttacggtctacgttcncgacccaagtccaactcacttgtcncttccg

SEQ ID NO: 432819 - DNA, 523 bp, Homo sapiens
  misc_feature: GZ8MTXP01D6K91.4.57.F02.1.454.CMB.2.raw
  modified_base (406)..(406): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgccaggataacctgtgtggaccagcagtcggaggtaaaagtgtacattggtacaggcagaagccaggccaggccccctgtggtggtcgtccgtatgatagcgaccggccctcagggatccctgagcgattcctctggctcccaactctgggaacacggccaccctgaccatcagcagggtcgaagcgggatgagccatatacngtcaggtgtagggggataggtagtggtgatcatccatcgtcttcggaactgggacaaggtcttccgtcctaacgttcacgccccaagggcccaacgtcccacttcgtccaacttccc

SEQ ID NO: 432820 - DNA, 565 bp, Homo sapiens
  misc_feature: GZ8MTXP01DC4W0.4.57.F02.1.454.CMB.2.raw
  modified_base (223)..(223): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataactgtgtgggaaccngcagtcgggaaggtaaaagtgtacattggtacaggcagaagccaggccaggccctgtggtggtctcgtatgatagcgaccggccctcgagggactccctgagcgattctctcggcctacaactctaggggaaaccacgggcccaccctgacccatccagcgagggtccgaaggccgggatgaggccgaattattactgtcagggtgtaggggattaggggtaaggtggtagatacatccgatacggtcttacgggaactgggaaccctaaaggtcttcccggtccttacgtccacgaccccgagggacccaacccatcgtcacttcctccgttcccaacccc

SEQ ID NO: 432821 - DNA, 596 bp, Homo sapiens
  misc_feature: GZ8MTXP01B6VVT.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgcaggataacctgtgtggaaccagcagtcggaaggtaaaagtgtacattggtacaggcagaagccaggccaggcccctggtggtggtcgtcgtatgatacgcgaccggcctcgagggactcccgtgacgcgacttcctcgtggcctaccaactcgtagggaaccacggcccaccctgaccatcagcgagggtacgaaggccggggatggacggccgtaactacgttacgtgtcgaagggttggtagggggattagggtagtgggtagtagtcgtatacctagttaccgtccgttacgggaacgttcggggaaccttaacgggttcccttccggttaccgtacgttccgacgaccccgaaggcccaacgtcccacgttcgtccaacgtttcccg

SEQ ID NO: 432822 - DNA, 594 bp, Homo sapiens
  misc_feature: GZ8MTXP01D4V6I.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacggccaggataactgtgtggaaccagcagtcgggaaggtaaaagtgtaacagttggtacaggcaagaagccaggccacggcccctgtggtggtcgtccgttatgatagccgaccggcctcgagggactccctgagcgattctctcggcctaccaactcgtacgggaaaaccaccggcccaccctgacccatccagcgagggtcgaaggccggggatcggaggccgaacttattactgtcgaggtggtagggattagggtagtggtgatcatccagtaccgtcgttacggaacgtcgggaaccaaggttccttacccgtccgttacgtccgaacgaccccgaacgggaccccaaaccccgtacgtcgtccaccttccttccgttaaccccctaacccc

SEQ ID NO: 432823 - DNA, 587 bp, Homo sapiens
  misc_feature: GZ8MTXP01D8TY7.4.57.F02.1.454.CMB.2.raw
  modified_base (205)..(205): a, c, t, g, unknown or other
  modified_base (415)..(415): a, c, t, g, unknown or other
  modified_base (532)..(532): a, c, t, g, unknown or other
  modified_base (539)..(539): a, c, t, g, unknown or other
  modified_base (552)..(552): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaaggggctggaagtggggtgctagttatagtggtttgataggaaactaaactaaattctatgcaagactccggtaggaaagggccgattccaccatcctaccaagagaactaatttacgaagaacactattagaattctaacagatacgaactagtctagagaacgccgaaggacgacggtctgtactattatgtgngagagtagtgtctagttcgttctttgacgtaggtcgggaccgacgggtaaccttcggtcctaccgtcctcctcgacgtccttaccgaccgaacggccctacgtccgtccttccccgnggtcccnccgtcgcttccgnggacgcctacgtcggtcgggcacgcggccggtccg

SEQ ID NO: 432824 - DNA, 513 bp, Homo sapiens
  misc_feature: GZ8MTXP01BIYVU.4.57.F02.1.454.CMB.2.raw
  modified_base (418)..(418): a, c, t, g, unknown or other
  modified_base (436)..(436): a, c, t, g, unknown or other
  modified_base (485)..(485): a, c, t, g, unknown or other
  modified_base (509)..(509): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaggtaaagtgtacattggtacaggcagaagccaggccaggccccctgtggtggtcgtccgttatgatagcgaccggccctcagggatccctgagcgattcctctggctccaactctgggaacacggccaccctgaccatcagcagggtcgaagccggggatgaggccgactatactgtcaggtgngggggatagtagtggtgntcatccatacgtcttcggaactgggaccaggtcttccgtcctacgttcncgcccaaggccaactcacttgtcnctcg

SEQ ID NO: 432825 - DNA, 586 bp, Homo sapiens
  misc_feature: GZ8MTXP01CBPTM.4.57.F02.1.454.CMB.2.raw
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaagtgtacattggtacaggcagaagccaggccaggcccctgtggtggtctcgtatgatgcgaccggcccgtcaggactccctgagcgattctcgtcggctccactctgggaaacgaccgccgaccctcgaccactcacgcgagggtcgaagcggggatggacggacgacgtattactgtcgaggtgtagggtagtagggtaggtggtcgagtcactcgagttacgtcttacgggtaacgtcggggacctaaacgggtcttcccggttaccttacggttacgaccgacccgaaccgggacccaaacccccaccgtcggtcccacttcctccggtttccccgttaacccccc

SEQ ID NO: 432826 - DNA, 564 bp, Homo sapiens
  misc_feature: GZ8MTXP01ADEOL.4.57.F02.1.454.CMB.2.raw
  modified_base (309)..(309): a, c, t, g, unknown or other
  modified_base (408)..(408): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcgggaggtaaaagtgtacattggtacaggcagaagccaggccaggcccctgtggtgtcgtccgtatgatagcgaccggcccncaggagtccctgagcgatctctcgctcaactctggaaacaccgccaccctcgacactcagcagggtcgaagcggggacgtgaggcgactatactgtcgngtggtgggagtagggtagtggttgattacatcactacgttcgttacggaacgtacgggtaccgaaacggtcgttcccgttcccgttacgttccgacgccccgaaccgggacccaacccctacgtcgttcacccttcttccgttcccgtaacccccc

SEQ ID NO: 432827 - DNA, 543 bp, Homo sapiens
  misc_feature: GZ8MTXP01ADDZZ.4.57.F02.1.454.CMB.2.raw
  modified_base (348)..(348): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagccgtgggggtccctgagactctcctgtgcagcgtctggattcgccttcagtgcctatggcatgcactgggtccgccaggctccaggcaaggggctggaatgggtggcagttatatggtttgatggaaactaacaaattctatgcagactccgtgaagggccgattcaccatctccagagacaatttcgagaacacattgaatctaacagatcgaaacngtctgagaagcccgaaggacacgggctgtcttatattgtgcgagagtaagtgtctatggtctttgaccagtcggggacgacgggaaccgtggtcgaccgtctcctcacgcttaccaccgacggcccacgtccgtcctccccttcggccgccgtcgcttccgcgacgcaccgtcgtcggggcacgcgccggtccgg

SEQ ID NO: 432828 - DNA, 587 bp, Homo sapiens
  misc_feature: GZ8MTXP01AMDGC.4.57.F02.1.454.CMB.2.raw
  modified_base (539)..(539): a, c, t, g, unknown or other
tcagagcactgtagcacgaccggtgctcgatttagctcgatataggttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaaggtaaagtgtacattggtacaggcagaagccaggccaggcccctgtggtgcgtccgtatgagtagcgaccggcccgtcgaggacgtacccgtgagcgacttctcgtcggctccaactcgtgggaaaccgaccgccgaccctcgacactcagcgagggtacgaagcccggggagtgacgggaccgactagttacctgtacgaggtaggtagggtagtacgggtaaggtggttcggagttcactaccactaacgttcgttaccggtaacgtacgggaccgtaaacggtcgttcccgtccgttaccgacncgacccgacggacccaaccccactcgcaccttctcgttccctaacccc

SEQ ID NO: 432829 - DNA, 580 bp, Homo sapiens
  misc_feature: GZ8MTXP01D1G7L.4.57.F02.1.454.CMB.2.raw
  modified_base (229)..(229): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccngcatcggaggtaaaagtgtacattggtacaggcagaagccaggccaggcccctgtggtgtcgtccgtatgatagcgaccggccctcgagggactcccgtgagcgattcctctggctccaactctcgggaacacggcccaccctgaccatcgagcgagggtcgaaggccggggatcggacggccgtatacgttactgtctagggtgtggggggattaggtaggtggtgtatcatccctagttccgtcgtttacgggaacgtggggaacccttaaggggttcccttccggttcctacggttccgacggaccccaagggcccctaaacgtcccacgttctccttaacgttcccg

SEQ ID NO: 432830 - DNA, 563 bp, Homo sapiens
  misc_feature: GZ8MTXP01BAOHZ.4.57.F02.1.454.CMB.2.raw
  modified_base (207)..(207): a, c, t, g, unknown or other
  modified_base (346)..(346): a, c, t, g, unknown or other
  modified_base (384)..(384): a, c, t, g, unknown or other
tcagagcactgtagcacgaccggtgctcgatttagctcgatatagttgggtttgggggaagaggaagactgacggtcctcccaggtgtccagtgtcaggtgcacctggtggagtcgggggaggcgtggtccagcctggggggtccctgagactctcctgtgcagcgtctggattcgccttcagtgcctatggcatgcactgggtccnccaggctccaggcaaggggctggaatgggtggcagttatatggtttgatggaactaacaaattctatgcagactcgtgaagggccattcaccatctccagagacaatttcgagaacacattgaatctacagatgaaacngtctgaagagccgaggacacgggctgtctattatgtgngagagtaagtggtacagttggtcctttgaccgtaggtcggggtccacgggggtaaccctgggtccaccggttctcctcgagtccttccgaccaacgggcccagtccggtccttccccgtcggccgccctcgccttccgacggtaacgcaaccgtcggtcgggggaccaacgcggcccgg

SEQ ID NO: 432831 - DNA, 589 bp, Homo sapiens
  misc_feature: GZ8MTXP01A8C7K.4.57.F02.1.454.CMB.2.raw
  modified_base (337)..(337): a, c, t, g, unknown or other
  modified_base (393)..(393): a, c, t, g, unknown or other
  modified_base (463)..(463): a, c, t, g, unknown or other
  modified_base (512)..(512): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccgaggcaaggggctggaatgggtgcagttatagtggttgatggaaactaacaaattcatgcagactcgtgaaggccatcacatctcagagactaattcgaagaacactaattgaaattctaanagatacgaaacagtctagaagaacgaccgaaggacacgggcttgtactattattgngcgagagtaagtgtactagtgttctttagactaggtcgggaccgagggtaccgtggtaccaccgtctccncgacgccttaccgaccgtaacgggccctacgtccggtcccttcccccgnggtcccgttcccgtcgtccgttcccgagggacgccgtaccgtccgggtacgggggcaaccgtcggcccgggtcccgg

SEQ ID NO: 432832 - DNA, 632 bp, Homo sapiens
  misc_feature: GZ8MTXP01ES6E9.4.57.F02.1.454.CMB.2.raw
  modified_base (360)..(360): a, c, t, g, unknown or other
  modified_base (398)..(398): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagccgtggggggtccctgagactctcctgtgcagcgtctggattcgccttcagtgcctatggcatgcactgggtccgccaggctccaggcaagggggctggaatggggtgcagttatagtggtttgataggaactaaacaaattctatgcagactccgtagaaggccattcacatctaccagagaactaatttcgaagaaacacattgaaatctaacagatgaaacngtctgaaagagccgaggacacgactgtactattattgngagagagtaagtgtactagttgtctttagaccgtaggtcggggaccgtaacgggggtaacccgttgggtacccacccggttcctcccgtacgacggtccttacccgaaccgtaacggggtcccctacgttcccggttcccctttcccccgtcggttcccgtccccgtcggcccttcccggacgggaaccgccgtaacccgttcggtcgggggacctaacggccgggtccccggg

SEQ ID NO: 432833 - DNA, 578 bp, Homo sapiens
  misc_feature: GZ8MTXP01EADLQ.4.57.F02.1.454.CMB.2.raw
  modified_base (287)..(287): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggcaggataacctgtgtggaaccagcatcggaaggtaaatgtacattggacaggcagaagccaggccaggccctggtggtggtcgtcgtangatagcgaccggcctgagggactcccgtgacgcgtattctcgtcggccttaccgaactcgtaggggaaaaccacgggcccacctgacccatcagcgagggtcgaaggccggggaatggacggccgtaactattacgtggtacagggtggtagggataggggtaggttcggtgaactcaactccaagttaccgtcgttacgggaacttcggggaacctaagggtccttccggtccttacgtcaacgccccgaaggccccaacccgatcgtccacttctccgttccccaaccc

SEQ ID NO: 432834 - DNA, 543 bp, Homo sapiens
  misc_feature: GZ8MTXP01AY9XO.4.57.F02.1.454.CMB.2.raw
  modified_base (356)..(356): a, c, t, g, unknown or other
  modified_base (416)..(416): a, c, t, g, unknown or other
  modified_base (426)..(426): a, c, t, g, unknown or other
tcagagcactgtagcacgaccggtgctcgatttagctcgatatagttgggtttgggggcctaaggaagcagcactggtggtgcctcagccatggcctggaccgttctcctactcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggccctgtggtggtcgtccgtatgatagcgaccggccctcgagggatcccgtgagcgattctctcggctccaactctcgggaaaccnccgggcccaccctgacccatcgagcgagggtcgaagccggggatgaggccgactattacngtcgaggtgngggtataggggtagtggtgatcgatccgataccgtctcggaactgggaccaaggtccttccggtccttacggtcacgcccgaggcccaacccatcgcacttctcgttccccaacccc

SEQ ID NO: 432835 - DNA, 670 bp, Homo sapiens
  misc_feature: GZ8MTXP01BFZNF.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatgggtgcagttatatggtttgatggaaactaacaaattctatgcagactcgtgaaggcattcacatctccagagacaatttcgaagaacacaattgaaatctaacagatagaacagtctgagaagcccgaaggacacggcttagtttattatgtgacgagagtaagtggtactagttcggttccttttaggacccgtagggttcggggaccgaacggggtaaaccccgtgggggttaccctaacccggttccttccccgttaccgaacggtccctttacccgaaacccgaaaccggggtccccctaacgttcccggttccctttccccccgttgggccccggtccccttcggccccgttccccgaacggggttaccccgacccgtaacccggttccgggtccggggacccgaccggaccgggtcccgggttccccggtcggg

SEQ ID NO: 432836 - DNA, 559 bp, Homo sapiens
  misc_feature: GZ8MTXP01AF7FM.4.57.F02.1.454.CMB.2.raw
  modified_base (513)..(513): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagcgtggtttcctcgttgctcttttaagaggtgtccagtgtcaggtgcacctgggtggaggtcggggggaggcgtggtccagccgtggggggtccctgagactctcctgtgcagcgtctggattcgccttcagtgcctatggcatgcacgtgggtcccgccaggcctccgaggccgaagggggctgggaagtggggtgctagttatagtggtttgagtggaaactaaacaaattctaatcgacagacctccggtaggaacgggccgattccacatctaccagagactaactttagaacaaacacaattaggaaatactaacaagtatagaacagtctaggagagccgaggaacacggctgttntattattgttgagaagtagtaagtggtacagtcggttctttaacgg

SEQ ID NO: 432837 - DNA, 621 bp, Homo sapiens
  misc_feature: GZ8MTXP01BQHDJ.4.57.F02.1.454.CMB.2.raw
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcatcggaaggtaaaagtgtaacattggtacaggcagaagccaggccaggcccctggtggtggtcgtccgttatgatagcgaccggccctcgagggactccctgagcgtattctctcggcctccaactcgtgggaaaccacggcccaccctgaccatcagcgagggtcgaaggccggggatggacggccgtaacttagtttacctggtcgaggggtgtagggggtattagggggtaaggtggggtagattcagttcccaagttaccgtcgtttaccgggaaacgttcgggggaaccctaaaggggttccttcccggttaccttaccggttccaacggccccgaaacgggccccaaacccccgtactcgtaccaccgttcctccgtttcccccgcccc

SEQ ID NO: 432838 - DNA, 575 bp, Homo sapiens
  misc_feature: GZ8MTXP01D3IMZ.4.57.F02.1.454.CMB.2.raw
  modified_base (239)..(239): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtggaaccagcatcggaagtaaagngtacagtggtacaggcagaagccaggccaggccctgtggtggtcgtccgtatgatagccgaccggccctcgagggactccctgagcgtattctctcggcctacaacgtcgtaggggaaaccaccgggcccacccgtgacccatcgacgcgaggggtacgaacgggccggggatggacggccgtaactagttacgtgtacgaggtgtagggattaggggtagtggtagatcatccagtacgtcgtacgaacgtgggaacctaaggtcttccgtccttacgtccgaacgacccgacggaccccaacccgctcgtccacttcctccgttccccaacccc

SEQ ID NO: 432839 - DNA, 543 bp, Homo sapiens
  misc_feature: GZ8MTXP01CK72Z.4.57.F02.1.454.CMB.2.raw
  modified_base (455)..(455): a, c, t, g, unknown or other
  modified_base (491)..(491): a, c, t, g, unknown or other
  modified_base (520)..(520): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggataactgtgtggaaccagcatcggaaggtaaaagtgtacagttggtacaggcagaagccaggccaggccctgtggtggtcgtcgtatgatagcgaccggccctgagggatccctgagcgattctctcggcctcaacgtcgtacggggaaaaccaccgggcccaccctgacccatcgagcgaggggtcgaaaggccggggatcggacggccgacttattacgtgtcgagggtgtgggataggggtagtggtnatcatccatacgtcttcggactgggacctaaggtcnccgtcacgtcacgcccacggcccaacccntcgcacttctcgttccccgtccc

SEQ ID NO: 432840 - DNA, 557 bp, Homo sapiens
  misc_feature: GZ8MTXP01CSK6A.4.57.F02.1.454.CMB.2.raw
  modified_base (337)..(337): a, c, t, g, unknown or other
  modified_base (418)..(418): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaaggtaaaagtgtacattggtacaggcagaagccaggccaggcccctgtggtggtcgtcgttatgatagcgaccggcctcgagggactccctgagcgattcccnctggctccaactctagggaacacggcccaccctgacccatcagcagggtcgaagccggggatggaggccgaactattacgngtcgagggtgtgggggtataggtagtgggtagatcatcccaagtaccgttctacgggaacttgggggaacccaagggttccttccggtaccctacgttccgacgccccaaggcccaacgtccacttcgtccaacttccg

SEQ ID NO: 432841 - DNA, 531 bp, Homo sapiens
  misc_feature: GZ8MTXP01AEKFG.4.57.F02.1.454.CMB.2.raw
  modified_base (311)..(311): a, c, t, g, unknown or other
  modified_base (360)..(360): a, c, t, g, unknown or other
  modified_base (502)..(502): a, c, t, g, unknown or other
  modified_base (526)..(526): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtgtcgtcgtatgatagcgaccggcctnagggatccctgacgcgatttccctctggcctccaactcgtcgggaaccncgggcccaccctgacccatcagcgagggtcgaaggccggggatgaggccgactattactgtcaggtggtgggggataggtagtggtgatcatccatacgtcgttcggaactgggacttaagggtccttccggtctacgttcngcccaaggccaactccacttgtcncgtcc

SEQ ID NO: 432842 - DNA, 524 bp, Homo sapiens
  misc_feature: GZ8MTXP01BB5H4.4.57.F02.1.454.CMB.2.raw
  modified_base (228)..(228): a, c, t, g, unknown or other
  modified_base (359)..(359): a, c, t, g, unknown or other
  modified_base (416)..(416): a, c, t, g, unknown or other
  modified_base (493)..(493): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccngcatcggaaggtaaagtgtacattggtacaggcagaagccaggccaggcccctgtggtggtcgtccgtatgatagcgaccggccctcgagggatccctgagcgattccctctggctccaactctgggaacncgggcccaccctgaccatcagcagggtcgaaggccggggatggacggccgatatacngtcagggtgtgggggataggtagtggtgagtcatccatcgtcttcggaactgggaccaggtcttccgtctacgttcncgcccaaggccaactccacttgtcaactccg

SEQ ID NO: 432843 - DNA, 520 bp, Homo sapiens
  misc_feature: GZ8MTXP01D0OUO.4.57.F02.1.454.CMB.2.raw
  modified_base (309)..(309): a, c, t, g, unknown or other
  modified_base (344)..(344): a, c, t, g, unknown or other
  modified_base (445)..(445): a, c, t, g, unknown or other
  modified_base (450)..(450): a, c, t, g, unknown or other
  modified_base (452)..(453): a, c, t, g, unknown or other
  modified_base (469)..(469): a, c, t, g, unknown or other
  modified_base (484)..(484): a, c, t, g, unknown or other
  modified_base (488)..(488): a, c, t, g, unknown or other
  modified_base (491)..(491): a, c, t, g, unknown or other
  modified_base (494)..(494): a, c, t, g, unknown or other
  modified_base (497)..(497): a, c, t, g, unknown or other
  modified_base (500)..(500): a, c, t, g, unknown or other
  modified_base (502)..(502): a, c, t, g, unknown or other
  modified_base (512)..(512): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagccgtggggggtccctgagactctcctgtgcagcgtctggattcgccttcagtgcctatggcatgcactgggtccgccaggctccaggcgagggggctagggatggggtggcagttatagtggtttgataggaactaaacaaattcatgcagactcgtgaaggccattcacatctcaganacatttcgagaacacattgaattcacagatgaacngtctgagaagccgaaggacacgggctgttacttatattgtgacgagtagtaagtggtcagttggttcctttgaccgaggtcgggcagggaccctggtaccncgtcncnncgtctacacgacgccncgtccgtcctcccgngccncgngcncgngcncncgtcgcggcncgcgcgcg

SEQ ID NO: 432844 - DNA, 531 bp, Homo sapiens
  misc_feature: GZ8MTXP01AXSXZ.4.57.F02.1.454.CMB.2.raw
  modified_base (227)..(227): a, c, t, g, unknown or other
  modified_base (363)..(363): a, c, t, g, unknown or other
  modified_base (431)..(431): a, c, t, g, unknown or other
  modified_base (497)..(497): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaggtaaaagtgtacattggtacaggcagaagccaggccaggcccctgtggtggtcgtccgttatgatagcgaccggccctcgagggactccctgacgcgattcctctggcctccaactctacgggaacncgggcccaccctgaccatcagcagggtcgaaaggccggggatggaggccgactatacgtgtcaggtgngggggataggtagtggtgatcatccatacgtctcggactgggaccagggtcttaccgtcacgttcncgcccgaagccaactccacttcgtccaacttccg

SEQ ID NO: 432845 - DNA, 649 bp, Homo sapiens
  misc_feature: GZ8MTXP01DL5QQ.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtacattggtacaggcagaagccaggccaggcccctggtggtggtcgtccgtatgatagcgaccggccctcgagggactccccgtgacgcgactttcctctggcctcccaacgtcgtaggggaaccaccgggcccaaccccgtcgacccatcagccgaggggtcgaacggccggggaatggacggccgtaacttagttaacgtgtacgagggttggtaggggggtattaaggtaaggttgggtagtactacgtattaccccgtaattaccggttcgtttaccgggaaacgttcgggggaacccttaaacggggttcccttacccggttaccctaccggttccgacggaccccgaaacgggtccccaaaccttcccgacttcggtaaccttccgtttaaccccg

SEQ ID NO: 432846 - DNA, 555 bp, Homo sapiens
  misc_feature: GZ8MTXP01BHT4B.4.57.F02.1.454.CMB.2.raw
  modified_base (218)..(218): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccacctcagtgtcagtcggcccagggcagacggcaggataactgtgtggaaccngcagtcggaagtaaagtgtacagttggacaggcagaagccaggccacggccctggtggtggtcgtccgtatgatagcgaccggcctcgagggactcccgtgagcgtattctctcggcctacaacgtcgtagggaaaccaccgggcccaccgtgacccatcgagcgagggtcgaaggccgggatggacggcgactattacgtgcgaggtgtaggatagggtagtgtgatcgatccagtacgtcgtacggacgtcgggacctaacgggtccttccgtccttacgtccgacgcccgaggaccccaacccactcgtccacttccgtccgttcccctaaccc

SEQ ID NO: 432847 - DNA, 547 bp, Homo sapiens
  misc_feature: GZ8MTXP01AHBLL.4.57.F02.1.454.CMB.2.raw
  modified_base (524)..(524): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccaggcagacggcaggataacctgtgtggaaccagcagtcggaaggtaaaagtgtacattggtacaggcagaagcaggccaggccctggtggtggtcgtcgtatgatagcgaccggccctcgagggactcccgtggacgcgattctctcggcctcaacgtcgtgggaaaccacggcccacctgacccatcgagcgaggggtcgaaggccggggatggacggccgactattactgtcagggtgtagggataggggtaggtggtcgatcgatcgatacgtctacggacgtggaccaaggtccttccgtcttacgtcacgcccgaacggcccaaccccntcgtcacttctcgttcccgtccc

SEQ ID NO: 432848 - DNA, 593 bp, Homo sapiens
  misc_feature: GZ8MTXP01DR9ER.4.57.F02.1.454.CMB.2.raw
  modified_base (225)..(225): a, c, t, g, unknown or other
  modified_base (336)..(336): a, c, t, g, unknown or other
  modified_base (361)..(361): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgcaggatacctgtgtggaaccngcatcggaaggtaaagtgtacattggtacaggcagaagccaggccaggcccctgtggtggtcgtccgttatgatagcgaccggccctcgagggactccctgagcgattccncgtggctcccaactcgtgggaaccncgggcccaacccgtgacccatcgagcgagggtcgaaagggcccgggggatcgggaacgggcccgtaactacttacgtgtcgagggttgtggggggattagggtaggtgggtgaatcgatccctagttaccgtcgttaccggggaactcgggggaacccttaaaggggtccctttccggtaccttacgttccacggaccccgaaggcccaactccacttcgtccaacttcccg

SEQ ID NO: 432849 - DNA, 589 bp, Homo sapiens
  misc_feature: GZ8MTXP01CF4Y0.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtacattggtacaggcagaagccaggccaggcccctgtggtggtcgtccgttatgatagcgaccggccctcgaggactcccgtgagcgtattctctcggcctcaactcgtcgggaaaccaccggcccaccctgaccatcagcgagggtacgaaggccggggatcgggacggccgaacgttagttactggtcgagggttgtggggattaggggtaaggttgggtagactctatccgattaccggtcgttacgggaacgtcggggaacctaacgggtccttcccggtccttacgtcacgacccgacggaccccaaccccactcgtcacttccttccgttccccgtcccc

SEQ ID NO: 432850 - DNA, 566 bp, Homo sapiens
  misc_feature: GZ8MTXP01BZYG7.4.57.F02.1.454.CMB.2.raw
  modified_base (228)..(228): a, c, t, g, unknown or other
  modified_base (301)..(301): a, c, t, g, unknown or other
  modified_base (384)..(384): a, c, t, g, unknown or other
  modified_base (428)..(428): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcagtcggaaggtaaaagtgtacattggacaggcagaagccaggccacggcccctggtggtggtcgtcgttangatagcgaccggcctcgagggctccctgagcgattcctctggctcccaacgtcgtagggaaccacggcccaccctgaccttancagcgagggtcgaacggccggggatggacggccgtatattacgngtacgagggtgtaggggggactaggtagtggtgatcatcccaattccgtcgttacgggaacgtcgggaaccgagggttcccttccgtaccgtaacgttccgccgacccgaagcccaactcccattcgtcaacgttccg

SEQ ID NO: 432851 - DNA, 650 bp, Homo sapiens
  misc_feature: GZ8MTXP01EIM2J.4.57.F02.1.454.CMB.2.raw
  modified_base (228)..(228): a, c, t, g, unknown or other
  modified_base (440)..(440): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccaggggcaggacggcaggataacctgtgtgggaaccngcagtcgggaaggtaaagtgtacagttggtaacaggcagaagccaggccaggcccctggtggtgtcgtccgtatgagtagcgaccggcctcgaggacgtcctgagcgatctcgtcggctcaactcgtaggaaacgaccgccgaccctacgaccactcgacgacgacgggtacggaacgcgggggacgtggacggcgtactattactgtacgnggtaggtgggtaagttaggggtaggttagggtgtagtacagttaccagtaaccggttcgttaccgggtaacggtacggggtaacccggaaacggttccggttcccgtacccggttaccgtaccgtaaccggaccccgaaccgggaaccccaacccccggtaacttccggttacccaccttcccgttcccggtttccccttaacccccccg

SEQ ID NO: 432852 - DNA, 510 bp, Homo sapiens
  misc_feature: GZ8MTXP01AB29I.4.57.F02.1.454.CMB.2.raw
  modified_base (225)..(225): a, c, t, g, unknown or other
  modified_base (332)..(332): a, c, t, g, unknown or other
  modified_base (351)..(351): a, c, t, g, unknown or other
  modified_base (405)..(405): a, c, t, g, unknown or other
  modified_base (414)..(414): a, c, t, g, unknown or other
  modified_base (465)..(465): a, c, t, g, unknown or other
  modified_base (478)..(478): a, c, t, g, unknown or other
tcagagcactgtagcacgaccggtgctcgatttagctcgatatagttgggttgggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggagtaaagtgtacattggtacaggcagaagccaggccaggcccctgtggtggtcgtccgttatgatagcgaccggcctcagggatcccctgagcgattccnctggctcaatctgggaacncgggccaccctgaccatcagcagggtcgaagccggggatgaggccgactatacngtcaggtgngggggataggtagtggtgatcatccatcgtcttcggaatggacaagggtcnccgtctacgttcncggcccaaggccaactccacttgtcaacgtcc

SEQ ID NO: 432853 - DNA, 526 bp, Homo sapiens
  misc_feature: GZ8MTXP01D650G.4.57.F02.1.454.CMB.2.raw
  modified_base (251)..(251): a, c, t, g, unknown or other
  modified_base (337)..(337): a, c, t, g, unknown or other
  modified_base (451)..(451): a, c, t, g, unknown or other
  modified_base (482)..(482): a, c, t, g, unknown or other
  modified_base (486)..(486): a, c, t, g, unknown or other
  modified_base (493)..(493): a, c, t, g, unknown or other
  modified_base (496)..(496): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccaggcaaggggctggaatgggtgcagttatagtggttnatggaaactaacaaattctatgcagactcgtgaagggccgattcaccatctccagagactaatttcgagaacacattgaatctaanagatcgaacagtctgagaagccgaaggacacgggctgtactattagttgtgcgagagtaagtggtacagttcgttctttgacgaggtgggacgagggaccgtgtcgacgtctcncagctaccacgacggccactcggtctcccgngccnccgtgcncgngacgcacgtcgcggggcacgcgcggtcccg

SEQ ID NO: 432854 - DNA, 553 bp, Homo sapiens
  misc_feature: GZ8MTXP01ANYPJ.4.57.F02.1.454.CMB.2.raw
  modified_base (177)..(177): a, c, t, g, unknown or other
  modified_base (227)..(227): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctnagtgtcagtggccccagggcagacggccaggataacctgtgtgggaaccngcagtcggaaggtaaaagtgtacagttggtacaggcagaagccaggccaggcccctggtggtggtcgtccgttatgatagcgaccggccctcgagggactccccgtgagcgtattcccgtctggcctcccaactcgtcgggaaccacgggcccaccctgaccatcagcagggtcgaaaggccgggggatggacggccgactacttacgtgtcagggtgtgggggagtagtgtggtgatcatccatcgtcttcggactgggaccaaggtccttccgtccgtaacgttccgagccccaaggccctaactccacttcgtcaaccttccg

SEQ ID NO: 432855 - DNA, 594 bp, Homo sapiens
  misc_feature: GZ8MTXP01EOCE2.4.57.F02.1.454.CMB.2.raw
  modified_base (299)..(299): a, c, t, g, unknown or other
  modified_base (368)..(368): a, c, t, g, unknown or other
  modified_base (430)..(430): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagaagccaggccaggcccctgtggtggtcgtcgtangatagcgaccggcctcgagggactcccgtgacgcgattccctcgtggcctcccaactcgtagggaaccncgggcccaccctgacccatcgagcgagggtcgaaggccggggatggacggcctatattacgngtcgagggtgtgggggataggtagtggtgatcagtccagtaccgtcgttacgggaactcgggggaaccttaacggggtccttcccggtacccgttaacggttcccgacggaccccgaaagggcccctaaacctcccgtaaccttcggttcccaacgtttccccg

SEQ ID NO: 432856 - DNA, 539 bp, Homo sapiens
  misc_feature: GZ8MTXP01BG80O.4.57.F02.1.454.CMB.2.raw
  modified_base (204)..(204): a, c, t, g, unknown or other
  modified_base (250)..(250): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaaggggctggaatgggtgcagttatatggtttnatggaaactaacaaattctatgcagactccgtgaaggccgattcaccatctccagagacaatttcgagaacacattgaatctacagatcgaacagtctgagaagccgaaggacacggctgtctattatgtgcgagagtaagtggtcagttggttctttgaccagtcgggcagggaacctggtcaccgtctctcacgcttaccaccaagggcccagtccggtccttccccgttggcccgcccgtcgccttccgcggacgccaccgtcgcggggcacgaacgccggtcccg

SEQ ID NO: 432857 - DNA, 515 bp, Homo sapiens
  misc_feature: GZ8MTXP01DDWGR.4.57.F02.1.454.CMB.2.raw
  modified_base (223)..(223): a, c, t, g, unknown or other
  modified_base (293)..(293): a, c, t, g, unknown or other
  modified_base (403)..(403): a, c, t, g, unknown or other
  modified_base (483)..(483): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacgcagataacctgtgtggaaccngcatcggaaggtaaagtgtacattggtacaggcagaagccaggccaggcccctgtgtggtcgtccgttangatagcgaccggccctcgagggactccctgagcgattcctctggctccaactctgggaacacgccaccctgaccatcagcagggtcgaagccgggatgaggcgatatacngtcaggtgtgggggataggtagtggtgatcatccatacgtcttcggaactggggaccaagggtccttccgtctacgttcncgcccaaggcccaactccacttgtccaactcc

SEQ ID NO: 432858 - DNA, 660 bp, Homo sapiens
  misc_feature: GZ8MTXP01EQWU0.4.57.F02.1.454.CMB.2.raw
  modified_base (332)..(332): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccaggcagacgcaggatacctgtgtggacagcatcggaggtaaaagtgtacattggtacaggcagaagccaggccaggcccctggtggtgtcgtccgtatgatagcgaccggcctcgagggactcccgtgacgcgtattccncgtggcctacccaaccgtcgtacggggaaccaccgggcccaccccgtagaacccagtcagccgaaggggtccggaaaggccgggggatgggaacgggccggaacttagttaccgtgtacgtagggttggtggggggtaattaggggttaaggtgggtaagtactccgaattccccgtaagttaccgggttaccgtttaccgggaaaccgttcgggggaaacccttaaagggggttcccttacccggtacccgtaacgggttaccacgggaccccctaaagggcccctaaacccggttccaaccgttcggttccttaaccgtttccccg

SEQ ID NO: 432859 - DNA, 592 bp, Homo sapiens
  misc_feature: GZ8MTXP01ESNH0.4.57.F02.1.454.CMB.2.raw
  modified_base (379)..(379): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggccaggataacctgtgtgggaaccagcagtacgggaaggtaaaagtgtacagttggtacaggcagaagccaggccaggcccctggtggtggtcgtccgttatgatagccgaccggccctcgagggactcccgtgagcgtattctcgtcggcctaccaacgtccgtaggggaaaacccnccgggcccaccctgacccatcgagcgagggtcgaagccgaggggatggacggtaccgacttagttacgtgtacgagggtggtgggagttaggtaggtggtagatcatccgaatacgtcgttacggaacgtggggaacctaaggttcctccgttccgtacgtcacgccccgaacggtccccaaccctctcgtaccacctccgttccgttccccc

SEQ ID NO: 432860 - DNA, 537 bp, Homo sapiens
  misc_feature: GZ8MTXP01DTRT8.4.57.F02.1.454.CMB.2.raw
  modified_base (414)..(414): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaggtaaaagtgtacattggtacaggcagaagccaggccaggcccctgtggtggtcgtccgttatgatagcgaccggccctcgagggactccctgagcgattcctctggctccaactctgggaacacggcccaccctgaccatcagcgagggtcgaaggccggggatggaggccatattacngtcgaggtgtgggggataggtagtggtagagtcatccattacgtcttcggaacgtgggaaccaaggtcttccggtcctacgttcgacgcccaaggcccaaactcccacttcgtcaacgttccc

SEQ ID NO: 432861 - DNA, 575 bp, Homo sapiens
  misc_feature: GZ8MTXP01ED6TQ.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacgcaggatactgtgtggaaccagcagtacgggaaggtaaaagtgtacattggtacaggcagaagccaggccaggccctgtggtggtcgtcgtatgatagcgaccggccctcgagggactccctgacgcgtattctctcggcctcgaactcgtcgggaaaccacgggcccaccctgacccagtcaggcgacggggtcgaacggccggggatggacgggaccgtaacttattacgtgtcgagggtggtagggtataggggtagtggtgatcatccagtaccgttcgtacggaacgtcgggaacctaacggtccttccgtccttacgtcaacgacccgaacggacccaacccgactcgtcacttctccggttccccgtcccc

SEQ ID NO: 432862 - DNA, 533 bp, Homo sapiens
  misc_feature: GZ8MTXP01BGH78.4.57.F02.1.454.CMB.2.raw
  modified_base (239)..(239): a, c, t, g, unknown or other
  modified_base (326)..(326): a, c, t, g, unknown or other
  modified_base (338)..(338): a, c, t, g, unknown or other
  modified_base (356)..(356): a, c, t, g, unknown or other
  modified_base (361)..(362): a, c, t, g, unknown or other
  modified_base (364)..(365): a, c, t, g, unknown or other
  modified_base (378)..(378): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagngtacatggtacaggcagaagccaggccaggcccctgtggtggtcgtccgtatgatagcgaccggcctcagggatccctgagcattcnctggctcaatcngggaaacacggccacctnaccannannaggagagcggagngagcgactatatgtgagtggtgggagtaggtagtggtgatacatacacgtacgtcgttcggtaacgtacggaccgaacggtacgttccgtcccttacgtacgacgacccgaacgacccaaccccacctaacgtctacttctcgttccctaacccc

SEQ ID NO: 432863 - DNA, 698 bp, Homo sapiens
  misc_feature: GZ8MTXP01AD8TO.4.57.F02.1.454.CMB.2.raw
  modified_base (219)..(219): a, c, t, g, unknown or other
  modified_base (225)..(225): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggataacctgtgnggaacngcatcggaaggtaaaagtgtacattggacaggcagaagccaggccaggccctggtggtggtcgtcgttatgatagccgaccggcctcgaagggactcccgtaggacgcgtactttcctctcggcctacccgaacgtcgtacggggaaccaccgggcccaacccgtgaacccatccgaacggacgaacgggggtaccggaacggggcccgggggaatcgggaacgggtacccgtaacttaacgttaccgtggttacggaggggtttaggtaggggggggaagttaaggggttagggtagggttaggaactacgtaacgtacccgtaagttacccgggttacgttaccggggaaacgttcgggggaaacccttaaaggggttcccttacccgggttacccgtaacggttaccgaccggaccccgaaagggacccctaaacgtcccctaacgttccgttaaccaaccgtttccccg

SEQ ID NO: 432864 - DNA, 538 bp, Homo sapiens
  misc_feature: GZ8MTXP01BEE65.4.57.F02.1.454.CMB.2.raw
  modified_base (417)..(417): a, c, t, g, unknown or other
  modified_base (427)..(427): a, c, t, g, unknown or other
  modified_base (445)..(445): a, c, t, g, unknown or other
  modified_base (531)..(531): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgtatgatagcgaccggccctcgagggatcccgtgagcgattccctctggctccaactcgtagggaacacggcccaccctgaccatcagcagggtcgaaggccgggatgacggccgatatacgngtcgaggtgngggggataggtagtggtnagtcatccatacgtcttcggaacgtcgggaccaaggtccttccgtcctacgttcgacgcccgaaggcccaactcccacttcgtccncgttccg

SEQ ID NO: 432865 - DNA, 548 bp, Homo sapiens
  misc_feature: GZ8MTXP01EK3Q8.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaaactaacaaattctatgcagactccgtgaaggccattcacatctccagagacaatttcgaagaacacattgaaatctaacagatcgaacagtctgagaagccgaaggacacggctgtctattattgtgcgagagtaagtggtctagtggttctttgaccagtgggacgacgggaaccgtggtctaccgtctcctcacgcttccaccaacgggccctacgtccggtccttccccgttcggccgcccgtcgccttccgcggcgccaccgtcgtcgggggccacgcgccggtcccg

SEQ ID NO: 432866 - DNA, 567 bp, Homo sapiens
  misc_feature: GZ8MTXP01AN9EQ.4.57.F02.1.454.CMB.2.raw
  modified_base (222)..(222): a, c, t, g, unknown or other
  modified_base (294)..(294): a, c, t, g, unknown or other
  modified_base (308)..(308): a, c, t, g, unknown or other
  modified_base (313)..(313): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacgcaggatactgtgtggaaccngcagtcggaaggtaaagtgtacattggtacaggcagaagccaggccaggcccctgtggtggtcgtccgttangatagcgaccgccncaggntcctgagcgattctctgctccactctcggaacacgccacctcgacactcacgcgagggtcgaacggccggggagtagacgggccgactacttacgtgtacgagggttgtgggggtagtaaggtaggtaggtaggatcgtataccgtatacggttcgttacggaacgtgggaacccgacggttcgttcccgtccgtaccgttcgaccgcccgaaacggccaacctacctaccttacgttccgaaccgtttccccg

SEQ ID NO: 432867 - DNA, 594 bp, Homo sapiens
  misc_feature: GZ8MTXP01CY28N.4.57.F02.1.454.CMB.2.raw
  modified_base (349)..(349): a, c, t, g, unknown or other
  modified_base (353)..(353): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcgggggaggcgtggtccagcctggggggtccctgagactctcctgtgcagcgtctggattcgccttcagtgcctatggcatgcacgtgggtccgccaggctccaggcaaggggctggaatggggtgcagttatatggtttgatggaaactaacaaattctatgcagactcgtgaaggccattcaccatctccagagactaattcgagaacacattgaatctacagactagaacngtcngaaagagccgagacacggctgtctattatgtgacgagagtaagtggtactagtggttctttgaccgaggtcggggaccgacgggggtaaccctgggtccaccggtctcctcgacgtccttcccgaaccgaacgggcccctacgtcccggttcccttcccccgtcggcccgtccccgtcgcccgttccgacgggaacgtcccgtaaccgtccggtcgggggacctaaccggcggtccccggg

SEQ ID NO: 432868 - DNA, 535 bp, Homo sapiens
  misc_feature: GZ8MTXP01BIGDK.4.57.F02.1.454.CMB.2.raw
  modified_base (269)..(269): a, c, t, g, unknown or other
  modified_base (426)..(426): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtggcccagggcagacgcaggatactgtgtggaaccagcatcggaagtaaagtgtacattggtacaggcagaagcagccagccctgtggnggctcgtatgatagcgaccggcctcaggactccctgagcgattctctcggctacaactactggaaacgacggccaccctagaccactcagcgagggtcgaagaccgggagtgaggcgactattactgtcgagtggtggagtaggtagtggtgactancacactacgtcgtacgtacgtacggacgaacgtacgttccgtccgttaccgtacgtacgaccgaccgacccgaacccacctaactctacttacctccgttccctaaccc

SEQ ID NO: 432869 - DNA, 605 bp, Homo sapiens
  misc_feature: GZ8MTXP01A8H7B.4.57.F02.1.454.CMB.2.raw
  modified_base (289)..(289): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccacccttagtgtcagtcggcccagggcagacggcaggatactgtgtgggaaccagcagtcgggaaggtaaaagtgtacattggacaggcagaagccaggccaggccctgtggtgtcgtcgttangatacgcgacccgcctcgagggactcccgtgacgcgtattcgtcgtcggcccctaccaaacgtcgtacggggaacccaacccgggacccaacccgtgaacccacgtccgaacggccgaagggggtacgaaacggggccggggaatcgggacggacccgtaattacgttactggtacgagggttgagggtattagggtagggtggtagatcagttccagttacgtcgtggtaacgtgggaccaggtcctcgttctacgcgaacgcccaacgcccaacccgtctcgtccactccttacccgttccccaacccgttccc

SEQ ID NO: 432870 - DNA, 545 bp, Homo sapiens
  misc_feature: GZ8MTXP01ASHA5.4.57.F02.1.454.CMB.2.raw
  modified_base (227)..(227): a, c, t, g, unknown or other
  modified_base (425)..(425): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggataacctgtgtgggaaccngcagtcggaaggtaaagtgtacattggtacaggcagaagccaggccaggcccctggtggtggtcgtcgtatgatagcgaccggcctcgagggactcccgtgagcgtattcctcgtggcctccaactcgtagggaaccacgggcccaccctgaccatcagcgagggtcgaaggccggggatggacggccgatagttacngtcgagggtgtgggggataggtagtggtgatcatccatcgtctacggactgggaccaggtccttcccgtcctacgttccgcgacccaacggcccaacctccacgttcgtccaacttcccg

SEQ ID NO: 432871 - DNA, 743 bp, Homo sapiens
  misc_feature: GZ8MTXP01DA0JV.4.57.F02.1.454.CMB.2.raw
  modified_base (229)..(229): a, c, t, g, unknown or other
  modified_base (301)..(301): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggccaggataacctgtgtggaaccngcagtcggaaggtaaaagtgtacattggacaggcagaagccaggccaggcccctggtggtggtcgtcgttangatagcgaccggcctacgagggactcccgtgacgcgtactttccctcgtcggcctacccgaaaccgttcgtacggggaacccacccggggccccaaaccccgttcggaacccctagtccgaacgggaccgtaagggggtaccggaaacggggcccgggggaatcggggaacgggtacccgtaacttaacgtttaccgtgtacggtaaggggttgggtaggggggtaagttaggggttaaggtggggttagaacgttacgaacttacccgtaacgttaaccggttaccggttaccggggaaaccggttaacgggggaaacccttaaacgggggttccccttaccccgggtttacccgtaaccgggttacccaccggacccccgtaaacgggcccctaaaaccgtcccgtaacttccgggttaacccttaacccgtttccccgg

SEQ ID NO: 432872 - DNA, 662 bp, Homo sapiens
  misc_feature: GZ8MTXP01EYFHE.4.57.F02.1.454.CMB.2.raw
  modified_base (296)..(296): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccaggcagacgcaggataacctgtgtggaaccagcagtacgggaaggtaaaagtgtaacagttggtacaggcaagaagccaggccaggccctggtggtggtcgtcgtangatgcgaccgcctcgaggactcccgtgagcgtattcgtcgtccggcctaccaacgtcgtacgggaaaacccacccgggcccacccgtgaacccatccgacggacggaacggggtaccggaaacgggcccgggggaatacgggaacggacccgtaacgttacgttaacgtgtacgagggttgggtaggggtaattagggggtaggttgggtagactacacgtaccgtaagttaccgtcgttacgggaacgtcgggaaccgtaacggtccgttacccgtccgttacgaccgaaccgaccccgaaccggacccccaaccccgtacgttccgtacctaccgttccgtaacccggtttcccccgtaacccc

SEQ ID NO: 432873 - DNA, 725 bp, Homo sapiens
  misc_feature: GZ8MTXP01BUQS6.4.57.F02.1.454.CMB.2.raw
  modified_base (226)..(226): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataactgtgtggaaccngcagtacgggaaggtaaaagtgtacagttggacaggcagaagccaggccaggccctggtggtgtcgtccgttatgagtacgcgacccggtccctagacggggactcccgtagacgcgtatttcccacgtggcctcccgaaactcggtacgggaaccaccgggccccaccctagaccactcgacgcgtaggggacggaaacggccgggggaatcgggaacgggtacccgtaaagttacgttaccgaggtcgaaggggttggaggggggtaaattagggtaaggttggggtatacttacggtaactacccgtaagttacccggttacgttaaccggggtaaccggtaacgggggaaacccttaaacgggggtttaccccttcccggttaaaccccgtttaacccgggttaccaacccgggttaaaccccccgaaacggggtaccccctaaaacctttcccccgaaacggttccggttaaccccttaacccgttttccccgg

SEQ ID NO: 432874 - DNA, 570 bp, Homo sapiens
  misc_feature: GZ8MTXP01EOBFU.4.57.F02.1.454.CMB.2.raw
  modified_base (541)..(541): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcagtcggaaggtaaaagtgtacattggtacaggcagaagcaggccaggccctgtggtggtcgtcgtatgatagcgaccgcctcagggactcccgtgagcgattctcgtcggcctccaactcctagggaaaaccaccgggcccaccctgacccagtcagcgaggggtacgaacggccggggatcggacggcgtactattacgtgtcgaggtggtgggattaggggtagtggtagatcagtccaagttaccgtcttacgggaactcggggaccctaagggtcttcccgtcttacgtcacgaccccgaggcccaacccntcgtccacttcctccgttcccctaacccc

SEQ ID NO: 432875 - DNA, 573 bp, Homo sapiens
  misc_feature: GZ8MTXP01EKRTO.4.57.F02.1.454.CMB.2.raw
  modified_base (251)..(251): a, c, t, g, unknown or other
tcagagcactgtagcacgaccggtgctcgatttagctcgatatagttggggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggttnatggaaactaacaaattcatgcagactcgtgaaggccgattcaccatctccagagacaatttcgagaacacattagatctacagactgaacagtctagagaacgccgaaggacacggctgtactattattgtgcgagagtaagtggtctattggttcctttgaccgagtcggggacacggggaacccgtggtcctaccgtctccgtcacgtccttaccaccgaacgggccctagtcccggtcccttccccgttcggcccgttcccgtcggtccttccgacgggacgcctaccgtcggtcgggggccacgcggccggtcccgg

SEQ ID NO: 432876 - DNA, 572 bp, Homo sapiens
  misc_feature: GZ8MTXP01AYPU5.4.57.F02.1.454.CMB.2.raw
  modified_base (228)..(228): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccngcatcggaaggtaaaagtgtacattggtacaggcagaagccaggccaggcccctggtggtggtcgtccgtatgatagcgaccggccctcgagggactcccgtgacgcgattcctctggcctccaactcgtagggaaccaccgggcccaccctgaccatcacgcgagggtcgaaggccggggatggacggccgatagttacgtgtcgaggtggtgggggtataggtagtggtgagtcagtccagtacgttcgttacggaacgttcggggaaccaacgggttccttcccggtcctaacggttccgacgccccgaaggcccaacgtccacgttcgtccaacttcccg

SEQ ID NO: 432877 - DNA, 742 bp, Homo sapiens
  misc_feature: GZ8MTXP01BZK88.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggccaggataacctgtgtggaaccagcagtcgggaagtaaaagtgtacagttggtacaggcaggaagccaggccacgggcccctggtggtggtcgtccgttatgagtagcggaccggcccgtccgagggagtccctggagacgtacgttctcgtcggtccgtcctaactaccgtacggggaaaccgacccggtcccgacccctacggacccaactcgaacggcggacggggtacggaacgggaccgggggtacgtggacgggacccggaacgttaacgtttacgtggtaccggagggttgggtaggggtaggttaggggttaagggtttaggggacgtacgttacgacgttacccgtacgttaacggttccgttaaccgggtaacggttaaccggggaacccggtaaacgggttcccggttcccggttacccttaccgggtttacccgaacgaacccccgaaccggggaaacccctaaccccctaacccgtccggttacccgaacccttcccggttaacccgtttcccccgtaacccccccg

SEQ ID NO: 432878 - DNA, 761 bp, Homo sapiens
  misc_feature: GZ8MTXP01CR0Y4.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggccccagggcagacggcaggataactgtgtaggaaccagcagtcggaaggtaaagtgtacagttggacaggcagaagccgaggccacggccccgtggtggtcggtcgtcgttatgagtacgccgaccggccctacgagggctcccgtgacgcgtacttcccgtcgtcggtacctacccgaaacgttccggtaacggggaaccctacccggggaccccctaaaccccgttcgaaacccctaagttccgaaacgggaccggtaacgggggtaccggaaacggggtcccgggggaatacgggaacgggtacccggtaaacttaacgtttaaccgtggttaccggaaggggttggggttaggggggtaacgttttaaaggggtagggttggggtacgtaaacttaccgtaacgttacccgtaacgttaacccgggttccgttaaccggggtaaaacggttcgggggaaacccttaacggggttcccttaccccgggttacctaaccggttcgaaccggaaccccgtaagggacccctaaccgttcccaacggttacctaacccttaaccgtttccccg

SEQ ID NO: 432879 - DNA, 640 bp, Homo sapiens
  misc_feature: GZ8MTXP01AX3AW.4.57.F02.1.454.CMB.2.raw
  modified_base (301)..(301): a, c, t, g, unknown or other
  modified_base (514)..(514): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggccaggataacctgtgtggaaccagcagtacggaaggtaaaagtgtaacattggtacaggcagaagccaggccacggccctggtggtggtcgtccgttangatagcgaccggcctcgagggactcccgtgacgcgtattctcgtcggcctaccaactcgtacgggaaaaccaccgggcccacccgtcgaacccacgtccgacggcgtaacggggtacggaaacggggcccgggggtatacggggaacggtacccgtaacgttagtttaacgtggtacgtaggggtaggtagggtagtaggggtaggtgggtanacgtcgactcctagttaccgtcgtacggaacgtcgggaaccgtaacggtccttccgttaccgttacgtccgaccgacccgacggccccaaccctgtcgtacctacttcctccgttcccctaacccc

SEQ ID NO: 432880 - DNA, 545 bp, Homo sapiens
  misc_feature: GZ8MTXP01BHDI8.4.57.F02.1.454.CMB.2.raw
  modified_base (540)..(540): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctggtggtggtcgtccgttatgatagcgaccggccctcgagggactccctgacgcgattcctctggctccaactctgggaacacggccaccctgaccatcagcagggtcgaaggccggggatggacggccgtaactagttaccgtgtcgagggtggtaggggggattaggtaggtggtgagtcatccagtacgtctcggaactgggaaccagggtccttccgtcctacgttcgacgcccaaggcccaactccgacttgtccnctccg

SEQ ID NO: 432881 - DNA, 747 bp, Homo sapiens
  misc_feature: GZ8MTXP01ER3TS.4.57.F02.1.454.CMB.2.raw
  modified_base (219)..(219): a, c, t, g, unknown or other
  modified_base (226)..(226): a, c, t, g, unknown or other
  modified_base (297)..(297): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgccaggatacctgtgnggaaccngcagtcggaaggtaaaagtgtacattggtacaggcagaagccaggccaggcccctgtggtggtcgtcgtangatacgcgaccggccctcgaggggactcccgtgacgcgatttccgtcgtggcctacccgaacttccgtaggggaacccaccggcccaccccttacggaacccctaagtccgaacgggacgaacgggggtaccgaaacggggcccgggggaagttacgggaacgggaccccgtaaacgttaacgtttaaccggtcggtaccgtagggggttaggttaggggggggtaatttaaggggttaagggttggggttagaaccgttccgtaaacttacccgtaacgttaacccgggtttccgttaccggggtaaaccggtccgggggtaaaccccgttacgggggtttcccttacccccgggtaccgttaaccgggttacccgaaccggacccccgtaaacgggacccctaaacccgttccctaaccggttccgttcccgttaacccgtttccccg

SEQ ID NO: 432882 - DNA, 672 bp, Homo sapiens
  misc_feature: GZ8MTXP01B5YCU.4.57.F02.1.454.CMB.2.raw
  modified_base (219)..(219): a, c, t, g, unknown or other
  modified_base (224)..(224): a, c, t, g, unknown or other
  modified_base (298)..(298): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggcaggatactgtgnggacngcagtacggaagtaaagtgtacagttggacaggcagaagccgaggccacggcccctggtggtggtcgtcgttangatacgccgaccggcctgagggactcccgtgacgcgtatttccctcgtcggcctacccaacgttcgtacgggaaccaccggcccacccgtagacccatcgaacggacggtaggggtaccggaaagggcccgggggatacgggaacgggtaccccgtaagttacgttacgtagggtacgtaaggggttgggtaggggggtaattaggggttaaggtgggtagtacttcgtaacttacccgtaagttaccgttccggttaccggggaacggttaacggggaacccgttaacgggttcccttacccggtacccgttacgacgacccgacccgaacggccctaaacctcccgacttcgtaacccttaacgtttccccg

SEQ ID NO: 432883 - DNA, 773 bp, Homo sapiens
  misc_feature: GZ8MTXP01DJCYU.4.57.F02.1.454.CMB.2.raw
  modified_base (150)..(150): a, c, t, g, unknown or other
  modified_base (175)..(175): a, c, t, g, unknown or other
  modified_base (231)..(231): a, c, t, g, unknown or other
  modified_base (569)..(569): a, c, t, g, unknown or other
tcagagcactgtagcacgaccggtgctcgatttagctcgatataggttgggtttgggggcctaaggaagcagcactggtggtgcctcagccatggcctggaccgttctcctcctcggcctcctctctcactgcacaggctctgtgacctnatatgtgctgactcacgcccacctnagtgtcaggtcggcccgagggcaggaccggcaaggactaacgtggtgacggaaccngcagtacgggaagtaaagtgtactagttaggacaggacaaggaacgccgacggcccgaccgggtcccgttgggtcgggttcggttccgttaccgtttaagtcggtacgtacgggccccggaaccccgggtccccgttacgggaacggggtaccttccccggtaggacggtccgtactttcgtcgtcccggaccctaccgaaaccgtcggtaaccggggaaaaccccacccgggccccaacccgtacgaaaccctacgtaccgaacggggccggaaacgggggtaccggaaacggggcccgggggtatacgggaacggtaccgtaacgttacgttacgngggtacggagggttgggtaaggggtagttagggggtaggttgggtataacgtactacgttcccgtaagttacccggttcgttaaccgggaacggtcgggaaccttaacgggttccttccggtacccgttacgacccgcggaaccccgacggacccctaaccgtcttccgtaccctccgttaccttccccgttcccctaaccccg

SEQ ID NO: 432884 - DNA, 580 bp, Homo sapiens
  misc_feature: GZ8MTXP01EWY7J.4.57.F02.1.454.CMB.2.raw
  modified_base (218)..(218): a, c, t, g, unknown or other
  modified_base (225)..(225): a, c, t, g, unknown or other
  modified_base (296)..(296): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacgccaggatacctgtgnggaaccngcatcggaaggtaaaagtgtacattggtacaggcagaagccaggccaggcccctgtggtggtcgtcgttangatagcgaccggccctcgagggactcccgtgacgcgattccctctggcctaccaacgtcgtacgggaaccaccgggcccaccctgacccatcagcgagggtcgaaggccgggatggacggccgtaatatacgtgtacgaggtgtagggggattaggtagtggtgatcatcctagtacgtcgttacggaacgtgggaacccttaagggtcccttccgtccgttaacgccgaccgaccccgaaacggccctaaacctcccacgttcgtccgttaaccgtttccccg

SEQ ID NO: 432885 - DNA, 535 bp, Homo sapiens
  misc_feature: GZ8MTXP01EAFAF.4.57.F02.1.454.CMB.2.raw
  modified_base (457)..(457): a, c, t, g, unknown or other
  modified_base (531)..(531): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccagcagtcggaaggtaaaagtgtacattggtacaggcagaagccaggccaggcccctgtggtggtcgtccgttatgatagcgaccggccctcgagggatccctgacgcgattcctctggctccaactcgtagggaacacggcccaccctgaccatcacgcgagggtcgaacggccggggatggacggcgtactattactgtcgagggtgtagggggataggtagtgggtanatcatacagtcgtcgtacggacgtcggacttacgtccttcgtcctcgcgcgaccgaacgccaactcacttctcnctcg

SEQ ID NO: 432886 - DNA, 615 bp, Homo sapiens
  misc_feature: GZ8MTXP01DY14P.4.57.F02.1.454.CMB.2.raw
  modified_base (205)..(205): a, c, t, g, unknown or other
  modified_base (254)..(254): a, c, t, g, unknown or other
tcagagcactgtagcacgaccggtgctcgattagctcgatatagtttggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccnccaggctccgaggcaaggggctggaatgggtgctagttatagtggtttnatggaaactaacaaattctatgcagactccgtagaaggccgattcaccatctacagagactaatttcgaagaacactattagaattctaacagattacgaaactagtctagagaacgcccgaaggacacgggtctagtacttaagttattgtgcgagagtaaggtgtactagttcggttcctttgacgtaggtacgggacgaacgggtaaccgtggtacctaccgttcctcctcgtacgtccgttacccgaaccgtacgggtaccctacgttcccgggttcccttccccggttcggtcccgcccgtcgccgttccgacggcgtccgaccgtcggtcgggggccaccggcggccggtcccgg

SEQ ID NO: 432887 - DNA, 541 bp, Homo sapiens
  misc_feature: GZ8MTXP01DKXKC.4.57.F02.1.454.CMB.2.raw
  modified_base (177)..(177): a, c, t, g, unknown or other
  modified_base (226)..(226): a, c, t, g, unknown or other
  modified_base (297)..(297): a, c, t, g, unknown or other
  modified_base (423)..(423): a, c, t, g, unknown or other
  modified_base (433)..(433): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctnagtgtcagtcggccccagggcagacggcaggataacctgtgtggaaccngcagtcggaaggtaaaagtgtacattggtacaggcagaagccaggccaggcccctgtggtggtcgtcgtangatagcgaccggccctgagggactcccgtgacgcgtattcctctggcctccaactcgtagggaaccacggcccaccctgaccatcgagcgagggtacgaaggccggggatggacggccgatatacngtcgaggtgngggggataggtagtggtgatcatccatcgtctcggaacgtcgggaaccagggtccttccgtcctacgttcgacgcccgaaggacccaacgtccattcgtccttctccg

SEQ ID NO: 432888 - DNA, 628 bp, Homo sapiens
  misc_feature: GZ8MTXP01DG7PO.4.57.F02.1.454.CMB.2.raw
  modified_base (214)..(214): a, c, t, g, unknown or other
  modified_base (221)..(221): a, c, t, g, unknown or other
  modified_base (333)..(333): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacgcagatactgtgnggaaccngcagtcggaaggtaaagtgtacagttggtacaggcagaagccaggccaggcccctgtggtggtcgtcgtatgatagcgaccggcctgagggactcccgtgacgcgtattccncgtggctacccaacgtcgtacgggaaccaccggcccacccgtgacccatcgagacgaggggtacggaaacgggccgggggaatcgggaacgggtcccgtaacttaacgttaaccgtgggtacgaggggttggtaggggggtaattaaggggttaaggtgggtagtacgtcgaacttacccgtaagttaccggttcgttaccgggaacgttcggggaacccttaaggggttcccttaccgtacccgttacgccgacgacccaacggccctaaactccacttcgtccaaccttcccg

SEQ ID NO: 432889 - DNA, 543 bp, Homo sapiens
  misc_feature: GZ8MTXP01DEZMD.4.57.F02.1.454.CMB.2.raw
  modified_base (358)..(358): a, c, t, g, unknown or other
  modified_base (525)..(525): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataacctgtgtggaaccagcagtcgggaaggtaaaagtgtacattggtacaggcagaagccaggccaggcccctgtggtggtcgtccgtatgatagcgaccggccctcaggggactccctgagcgattctctcggctaccatctgggaaaccncggccaccctgaccatcagcagggtcgaagccggggatggaggccgatattactgtcgaggtgtagggataggggtacgtggtagatcatccatacgtcttggaactcgggaacctaagggtccttccggtccttacgtcacgcccgaggcccaaccccatcgtacncttctcgttcccgtcccc

SEQ ID NO: 432890 - DNA, 568 bp, Homo sapiens
  misc_feature: GZ8MTXP01CQZ7G.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataactgtgtgggaaccagcagtcggaaggtaaaagtgtacagttggtacaggcagagccaggccaggcccctggtggtggtcgtcgttatgatagcgacccggcctcgaggggactcccgtgagcgtattctcgtcggctaccaactcgtacggggaaaccaccggcccaccctgacccatcagcgaggggtcgaaggccggggatggacggccgaattacttactggtcgaggtggtagggataggggtagtgggtgatcatccagtacgtcttcggaacgtcgggactaaggtcttccgtcttacgtcgacgcccgaacggccccaacccactcgccacgttcctcgttcccctaacccc

SEQ ID NO: 432891 - DNA, 677 bp, Homo sapiens
  misc_feature: GZ8MTXP01BIDJI.4.57.F02.1.454.CMB.2.raw
  modified_base (227)..(227): a, c, t, g, unknown or other
  modified_base (342)..(342): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataacctgtgtggaaccngcagtcggaaggtaaaagtgtacattggtacaggcagaagccaggccaggcccctggtggtggtcgtcgtatgatagcgaccggccctcgagggactcccgtgacgcgattcccncgtggcctaccaaactcgtacgggaaccaccgggacccaccctggaaccactcgaacggcgaggggtacgaaacgggccgggggaatgggaacgggccgtaacttaagttaccgtggtcgtaaggggtggttaggggggattagggtagtggggtagatccagtacccgtaagttacccggttacgttaccggaaacggtcggggaaacccttaacggggttcccttcccggttacccgttaaccggttccgaaaccgggttacccccgaaaacggggtaccccctaaaccggtttacccaacccgttacggtccccgttaacccgttttccccg

SEQ ID NO: 432892 - DNA, 524 bp, Homo sapiens
  misc_feature: GZ8MTXP01ADV8B.4.57.F02.1.454.CMB.2.raw
  modified_base (359)..(359): a, c, t, g, unknown or other
  modified_base (412)..(412): a, c, t, g, unknown or other
  modified_base (440)..(440): a, c, t, g, unknown or other
  modified_base (452)..(452): a, c, t, g, unknown or other
  modified_base (493)..(493): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgtatgatagcgaccggcctcgagggactccctgacgcgattcctctggctccaactctgggaacncgggcccacctgaccatcagcagggtcgaaggccgggatgaggccgatatacngtcaggtgtgggggataggtagtggtgntcatccatcgtnttcggaagtcgggaaccagggtccttccgtcctacgttcgngcccaaggccaactccacttcgtcaacttcc

SEQ ID NO: 432893 - DNA, 682 bp, Homo sapiens
  misc_feature: GZ8MTXP01CUW8N.4.57.F02.1.454.CMB.2.raw
  modified_base (173)..(173): a, c, t, g, unknown or other
  modified_base (278)..(278): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcagtcggcccagggcagacggcaggataacctgtgtggaaccagcagtcggaagtaaagtgtacagttggtacaggcagaagcaggccaggccctgtggngtcgtccgtatgatagcgaccggcctcgaggatcctcgagcgattctcgtcggctcactctcggaaacacccggccaccctcggaaccactacacggacacggggtacgaaacggcccgggggaagtcgggacggacccggaacgttaacgttaacgtcggttacgagggtggtaggggtagttaggtagggttggttgatacgacgtactacgtaacgttcgttacgggtaacgtacggggaacgtaaacgggttccgttccccgggttaccttaaccgggttacctaacccgggaccccgttaaaccgggggacccccgaaaaccccccgtaacccttaaccgggttaccccgtaaaccgttacccttttccccgggttaacccccgtttaaaccccccccg

SEQ ID NO: 432894 - DNA, 537 bp, Homo sapiens
  misc_feature: GZ8MTXP01CZSDR.4.57.F02.1.454.CMB.2.raw
  modified_base (447)..(447): a, c, t, g, unknown or other
  modified_base (487)..(487): a, c, t, g, unknown or other
  modified_base (501)..(501): a, c, t, g, unknown or other
tcagagcactgtagcacgaccggtgctcgatttagctcgatatagttgggttgggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtggaaccagcatcggaaggtaaagtgtacattggtacaggcagaagccaggccaggcccctggtggtggtcgtccgtatgatagcgaccggccctcgaggactcccgtgagcgattccctctcggctccaactctacgggaacacggccaccctgaccatcacgcagggtcgaaggccggggatcggacggcccgaatattacgtgtacagggtgtgggggtataggttagnggtgatcatccatacgtctacggaactgggacagggtccncgtcctacggttcncgacccgaaggcccaacgtcacttcgtcaacgttcc

SEQ ID NO: 432895 - DNA, 659 bp, Homo sapiens
  misc_feature: GZ8MTXP01CHJAY.4.57.F02.1.454.CMB.2.raw
  modified_base (211)..(211): a, c, t, g, unknown or other
  modified_base (217)..(217): a, c, t, g, unknown or other
  modified_base (292)..(292): a, c, t, g, unknown or other
  modified_base (322)..(322): a, c, t, g, unknown or other
  modified_base (365)..(365): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacgcaggatactgtgnggaacngcagtcggaaggtaaatgtaacagttggacaggcaagaacgccgaggccacggccctggtggtggtcgtcgttangatagccgacccggcctcgaggactcccgngacgcgtattctcgtcggcctaccaactcgtacgggaaaaccnccggcccacccgtacgacccataccgagcgacggggtacgaacgggccgggagtcgggacggccgtaattacgttacgtggtacgagggtggtaggggtaattgggggtaggttggggtatacgtacacgtcccgtaagttaccggttacgttaccgggaacgtcgggtaaaccgtaacgggttccttacccggtacccttacggtacccaaccggttaccccgaaaccgggacccctaaaacccccgtcgtccgtaccctaccgttccttcccgttaacccccctaacccccg

SEQ ID NO: 432896 - DNA, 598 bp, Homo sapiens
  misc_feature: GZ8MTXP01EFW5M.4.57.F02.1.454.CMB.2.raw
  modified_base (211)..(211): a, c, t, g, unknown or other
  modified_base (218)..(218): a, c, t, g, unknown or other
  modified_base (363)..(363): a, c, t, g, unknown or other
  modified_base (415)..(415): a, c, t, g, unknown or other
  modified_base (566)..(566): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccacctcagtgtcagtcggcccagggcagacgcagataacgtgtgnggaaccngcagtacggaaggtaaaagtgtaactagttggtacaggcaagaacgcgaggccaggccctggtggtggtcgtcgtatgatacgcgaccgcctgaggactccctggagcgtattctctcggcctaccgaactcgtacggaaaaccncgggcccacccgtagacccagtcacggtcgaagggtaccgaaggccggggancggacgacgtactattacgtgtacgaggtgtagggagttaggggtagtggtacgtatctaactccgtaagtaccgttcgtacgggaacgttcgggaaccgaagttccgttccgtaccttacgccgaacgcccgacggaccccaaaccccgngtaacctcaccttccgtccgttccccaacccc

SEQ ID NO: 432897 - DNA, 560 bp, Homo sapiens
  misc_feature: GZ8MTXP01A023Y.4.57.F02.1.454.CMB.2.raw
  modified_base (295)..(295): a, c, t, g, unknown or other
  modified_base (334)..(334): a, c, t, g, unknown or other
  modified_base (360)..(360): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcgggaaggtaaaagtgtacattggtacaggcagaagccaggccaggccctgtggtggtcgtccgttangatagcgaccggcctcagggactcccgtggagcgattcnctcggcctcaaactctgggaaaaccnccgggcccaccctgacccatcagcgagggtccgaaggccggggaatcggaggccgacttagttactgtcagggtgtagggataggggtagtggtcgatcgatccgatacgtcttacggactgggaccaagggtcttccgtccttacggtcacgccccaaggcccaacccactcgtaccacttccgtcgttccccgtcccc

SEQ ID NO: 432898 - DNA, 539 bp, Homo sapiens
  misc_feature: GZ8MTXP01B4ZX0.4.57.F02.1.454.CMB.2.raw
  modified_base (226)..(226): a, c, t, g, unknown or other
  modified_base (298)..(298): a, c, t, g, unknown or other
  modified_base (453)..(453): a, c, t, g, unknown or other
  modified_base (457)..(457): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccngcatcggaggtaaaagtgtacattggtacaggcagaagccaggccaggcccctggtggtggtcgtccgttangatagcgaccggccctcgagggactccctgagcgtattccctctggctcccaactcgtcgggaaccacgggcccaccctgacccatcagcgagggtcgaaggccggggatcggacggccgactagtactgtcgagggtggtgggggataggtagnggtnatcgatccatcgtcttcggatgggacagggtcttccgtcctcgttcgcgcccaaggcccaacgtccacttgtccaacgttcc

SEQ ID NO: 432899 - DNA, 608 bp, Homo sapiens
  misc_feature: GZ8MTXP01DB9QC.4.57.F02.1.454.CMB.2.raw
  modified_base (250)..(250): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggttnatggaaactaacaaattctatgcagactccgtgaagggccattcacatctccagagacaatttcgagaacacatgaatctacagatacgaacagtctagagaacgccgaaggacacgggctgtctattatgtgcgagtaggtaagtggtacagttggttccttttaggacctaggtggggaccgacgggaacccgttcggtctaccgtcctcctcacgtccttaccaccgtaacgggccctacgtcccggtccctttccccgttcgggtcccgccccgttcggcccttacccgcgggttaccgcccggtaacccgtccgggttcggggggcccaaccggtcggcccggggtccccggg

SEQ ID NO: 432900 - DNA, 591 bp, Homo sapiens
  misc_feature: GZ8MTXP01B9JOQ.4.57.F02.1.454.CMB.2.raw
  modified_base (326)..(326): a, c, t, g, unknown or other
  modified_base (369)..(369): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtacgggaaggtaaaagtgtacattggtacaggcagaagccaggccaggcccctgtggtggtcgtcgtatgatagcgaccggcctcgagggactcccgngagcgattcgtctcggcctaccaacttccgtaggggaaaaccnccgggcccacccctgacccatcagcgaggggtcgaaggccggggatgggacggccgaactattacgtgtcgagggtgtagggattaggggtaggtggtgatcactccagtaccgtcttacgggaactcggggaacctaaggtccttcccggtccttacgtacgaccgcccgacggaccccaaacccctcgtcgtccctacttccttccgttcccctaacccc

SEQ ID NO: 432901 - DNA, 521 bp, Homo sapiens
  misc_feature: GZ8MTXP01EG9JM.4.57.F02.1.454.CMB.2.raw
  modified_base (334)..(334): a, c, t, g, unknown or other
  modified_base (354)..(354): a, c, t, g, unknown or other
  modified_base (489)..(489): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaggtaaagtgtacattggtacaggcagaagccaggccaggccccctgtggtggtcgtccgtatgatagcgaccggccctcagggatccctgagcgattccnctggctcaactctgggaacncgggccaccctgaccatcagcagggtcgaagccggggatgaggccgactatactgtcaggtgtgggggataggtagtggagatcatccatacgtcttcggaactggggaccaagggtccttccgtctaacgttcncgcccaaggccaactccacttgtccaacttcc

SEQ ID NO: 432902 - DNA, 563 bp, Homo sapiens
  misc_feature: GZ8MTXP01ARQCD.4.57.F02.1.454.CMB.2.raw
  modified_base (299)..(299): a, c, t, g, unknown or other
  modified_base (432)..(432): a, c, t, g, unknown or other
  modified_base (463)..(463): a, c, t, g, unknown or other
  modified_base (535)..(535): a, c, t, g, unknown or other
  modified_base (542)..(542): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtacagttggtacaggcagaagccaggccaggcccctgtggtggtcgtccgttangatagcgaccggccctcgagggactcccgtgagcgtattctcgtcggcctaccaactccgtaggggaaaccaccgggcccaccctgacccatcagcgagggtcgaaggccggggatggacggcgatattacgngtcgagggtgtagggtataggggtggtggtnagtcgatccatacgtcgttacggacgtcgggacaaggtcttccgtcacgtcacgcccgacgccccaaacccntcgaccncttcctccgttccccgtcccc

SEQ ID NO: 432903 - DNA, 634 bp, Homo sapiens
  misc_feature: GZ8MTXP01BRA1L.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcagtcggaaggtaaaagtgtacattggtacaggcagaagccaggccaggcccctgtggtggtcgtccgtatgatagcgaccggccctcgagggactccccgtgacgcgattccctcgtggcctccaactcgtcgggaaccacgggcccaccctcgaccatcagcgagggtcgaacgggccggggatcggacggccgactacgttactgtcgagggtggtaggggggattaggtaggttggtagagtctacgtcccaagttaccggtcgttaccggggaaaccgttcgggggaaacccttaaagggggttccccttacccggttacccgttaaccggttcccgacggttacccccgaaacgggcccctaaaccttcccgaacttcgtaacccgttaactttccccg

SEQ ID NO: 432904 - DNA, 855 bp, Homo sapiens
  misc_feature: GZ8MTXP01BUY6D.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagaagccaggccaggcccctgtggtggtcgtcgtatgataggcgaccggccctcgagggactccccgtgacgcgatttccctccgtgggcctaccctaaacgtccgtacggggaaccacccggggacccaaccccgttacgaacccctaagttccgaacgggtcccgtaagggggtacccggaaacggggccccgggggaagttacggggaacgggacccggtaaccttaacgtttaaccgtcgggttaccgtaaggggttgggtacggggggggtaaacgtttaaggggttagggttagggggttaacgggtaacgttacccttaacggttacccgtaaacggtttaacccgggtttaccggttttaacccgggggtaaaacccggttaacgggggggtaaaaccccgttaaaaccgggggttccccgtttacccccggggttaaccccgttaaaccgggtttaccccggttaaaccggggttaaacccccccgggaaaaaccgggggtaaccccccgttaaaaccccttacccccgggtaaaaccctttccggggtttaacccccgttaaccccgtttttaacccccggg

SEQ ID NO: 432905 - DNA, 556 bp, Homo sapiens
  misc_feature: GZ8MTXP01CG11G.4.57.F02.1.454.CMB.2.raw
  modified_base (211)..(211): a, c, t, g, unknown or other
  modified_base (294)..(294): a, c, t, g, unknown or other
  modified_base (332)..(332): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggataaccngtgtggaaccagcagtcgggaagtaaaagtgtacattggtacaggcagaagccaggccaggccctgtggtggtcgtccgttangatagcgaccggccctgagggactccctgagcgattcnctcggctcaactcgtacgggaaaccacgggccaccctgaaccatcacgcgagggtacgaaggccggggatggacggcgaactattactgtcaggtgtgggagttaggggtagtggtgaatgatcatacgtcttacggacgtcgggaccaaagggtcttccggtccttacgacgtcgacccgacggaccaacccccgatcgtcacttcctccgttccccgtcccc

SEQ ID NO: 432906 - DNA, 677 bp, Homo sapiens
  misc_feature: GZ8MTXP01BU3B6.4.57.F02.1.454.CMB.2.raw
  modified_base (220)..(220): a, c, t, g, unknown or other
  modified_base (295)..(295): a, c, t, g, unknown or other
  modified_base (375)..(375): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggcccagggcagacgcaggataactgtgaggacngcagtcggaaggtaaagtgtacagttggacaggcaagaacgccgaggccacggcccctggtggtggtcgtcgtangatacggcgaccggcctgagggactcccgtagacgcgtattcccgcgtcggcctacccgtaacgtcgtaacgggaacccnccgggtacccaacccgtgaacccagtaccgaacgggaccgaggggtaccgaaacggggcccggggtaatcggggaaccggcccgtaacgttacgttaccgtaggtacggtaaggggttgggtacgggggggtaattaggggttaacggtgggttagaacttccgaacttaccccgtaaggttacccggttacggtttaccgggaaacgttcggggaaacccttagggttcccttccgtacccgtacgttaccgaccgacccgaaacggccctaaccttccacttcgtccttaacgtttcccg

SEQ ID NO: 432907 - DNA, 600 bp, Homo sapiens
  misc_feature: GZ8MTXP01CZOR3.4.57.F02.1.454.CMB.2.raw
  modified_base (378)..(378): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccagcatcggaaggtaaaagtgtacattggtacaggcagaagccaggccaggcccctggtggtggtcgtccgttatgatacggcgaccggccctcgaggggactcccgtgacgcgtacttccctcgtggcctacccgaactcgtacgggaaccncgggacccaaccctcggacctatcagccgaggggtcgaacgggccgggggatgggacggccgaacttattacgtgtcgaagggtggtagggggaattaggtaggtggtagatcgtatcccagttaccggtctacgggaacgtgggacccgaaggttcccttcgttaccgtacgttaccgcggaccccgtaaggcccaacgtccacttcgtccaactttcccg

SEQ ID NO: 432908 - DNA, 635 bp, Homo sapiens
  misc_feature: GZ8MTXP01ANZLT.4.57.F02.1.454.CMB.2.raw
  modified_base (225)..(225): a, c, t, g, unknown or other
  modified_base (297)..(297): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacggcaggataacctgtgtggaaccngcagtcggaaggtaaagtgtacagttggtacaggcagaagccaggccaggccctgtggtggtcgtccgttangatacgcgaccggcctcgacgggtactcccgtgacgcgtactttcctcgtcggcctcccaaacgtccgtacggggaaccaccgggcccaccctcgaccacgtcacggcgacggggtacggaaacgggccggggtatcgggacgggccgtaacttacgttacgttgtacgtaggggttggtaggggggtaaattaggggttaagtgggtacgtataccgtagttaccctagttaccggttaccgttaccgggaaacgttcggggaaccttaacgggttccttcccggtaccgtacgttccgacgcccgaacgcccaactcccacttcgtccgcttcccg

SEQ ID NO: 432909 - DNA, 721 bp, Homo sapiens
  misc_feature: GZ8MTXP01DXMNQ.4.57.F02.1.454.CMB.2.raw
  modified_base (266)..(266): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtgcagtatatgttgatgaataacaaatntatgcagactccgtgaagggccgattcaccaatctccagagacaaatttcgaaagaacaacatagtaatactaacaagaatagaaacaagtactagaaagacgccggaacggaacgaacggacgtacgttacttaatttaattagtgtacggaaggtaaaggttaaaggttaggttacgtacgttacggtttaccgttttacgttaaccgtaacggtacggggtaccggtaacggtaacgggtaaacccggttaccggttaccgtacccgtacccgttacccgtacctaaccgtaccgttacccgtaaaccccgtaaacccgggaaccccggtaaccgtacccggttccccgtttcccccgttccccggtcccgtccccgttcccgttccgttacccgtaaccggaccggaaccgtacccgtaccggttaccgggtaaccgggaaccggtaacgg

SEQ ID NO: 432910 - DNA, 616 bp, Homo sapiens
  misc_feature: GZ8MTXP01AOM2Q.4.57.F02.1.454.CMB.2.raw
  modified_base (301)..(301): a, c, t, g, unknown or other
  modified_base (575)..(575): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagaagccaggccacggcccctgtggtggtcgtcgttangatagcgaccggcctcgagggactcccgtgacgcgattcctcgtggctcccaacgtccgtaggggaaccaccgggacccacccctcgaccatcgaagccgaggggtacgaaacgggccgggggaatgggaacgggcccgtaacttagttaaccgtggtcgaaggggttggtaggggggaattagggtacggttgggtagagtcacgtacctagttaaccggtcgttacgggaacttggggaacccttaaagggtccttccggtcctacggttcncgttccccaaggccctaactccacttcgtcttaaccgttcc

SEQ ID NO: 432911 - DNA, 598 bp, Homo sapiens
  misc_feature: GZ8MTXP01EB16J.4.57.F02.1.454.CMB.2.raw
  modified_base (412)..(412): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgcaggataacctgtgtggaaccagcagtacggaaggtaaaagtgtacagttggtacaggcagaagccaggccaggcccctggtggtggtcgtcgttacgtgtatagtcgaccggcccgtcgaggacgtcctcgagcgacttctctcggctccaacgtcgtcggaaacaccggccaccctacgaccactcagcgacgggtcgaacggcgggagngtaggaccgaccgtattaactcgtcgaggtgtagggtagtagggtaggtaggtgagtcacgtacctagtacgttcgttccggtaacgtacgggtaccgtaaacgtccgttccggtacccttacggtaccgacgacccgacggacccaaccccactccgtcgacttccttccgttcccgtaaccccc

SEQ ID NO: 432912 - DNA, 637 bp, Homo sapiens
  misc_feature: GZ8MTXP01BEQJB.4.57.F02.1.454.CMB.2.raw
  modified_base (403)..(403): a, c, t, g, unknown or other
  modified_base (456)..(456): a, c, t, g, unknown or other
  modified_base (508)..(508): a, c, t, g, unknown or other
  modified_base (605)..(605): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccaccctcagtgtcaggtcggccccgagggcaggaccggccaaggactaaccgtgtggtagggaaccagcagtacgggaaggtaaaagtgtaactagttaggtaacaggacaaggaacgccgaggccacgggtccctggtggtcggtcgtcgttatgatcggccgaccggcctcggacgggactcccgtaggacgcgtattctcgtcggcctaccaacgtcgtacggggaaacccnccgggcccacccgtgaccctatcgagcgtacggggtacgaacggccggggtanggacggctattacttacgtgcgagggtgtagggataggggtgtggtgacttnacgtcctagtaccggttcgtaccgggaacgtcgggaacctaagggtcccttaccggtccttacggcaaccggaccgaaccggcccctaaaccccgtntccgcctaccgttccttcccgttccccaaccc

SEQ ID NO: 432913 - DNA, 563 bp, Homo sapiens
  misc_feature: GZ8MTXP01BGHZI.4.57.F02.1.454.CMB.2.raw
  modified_base (205)..(205): a, c, t, g, unknown or other
  modified_base (251)..(251): a, c, t, g, unknown or other
  modified_base (358)..(358): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaaggggctggaatgggtgcagttatatggtttnatggaaactaacaaattcatgcagactccgtgaaggccgattcaccatctcagagacaatttcgagaacacattgaatctacagatcgaacagtctagagaagccgnggaccaggctgtctattagtgtgcgagagtagtgtactagtcgttctttgacgtagtcgggacagggacccgtggtccgaccgtctcctcgacgccttaccaccgtaacgggcccctagttcccggttcccttccccgttcggcccgttcccgtgcccttccgaggaccgcctaccgtcggtcggggccacggcgccggtcccgg

SEQ ID NO: 432914 - DNA, 594 bp, Homo sapiens
  misc_feature: GZ8MTXP01CJHAT.4.57.F02.1.454.CMB.2.raw
  modified_base (299)..(299): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcagtcggaaggtaaaagtgtacattggtacaggcagaagccaggccaggcccctgtggtggtcgtcgtangatagcgaccggcctcgagggactcccgtgacgcgtattcccgtctggctcccaactccgtacgggaacaccgggtcccacccgtgacccatcagcgaggggtcgaacggccgggggatcgggacggaccgacttagttacgtgtacgagggttggtagggggattaggtaggtggtgagtcaatccattccgtcttacgggaacgtcggggaaccacgggttccttccggttacctacggttccgacggaccccgaaacgggcccaacgtcccacgttcgtccaacctttcccg

SEQ ID NO: 432915 - DNA, 551 bp, Homo sapiens
  misc_feature: GZ8MTXP01AR5RD.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatacggaaggtaaaagtgtacattggtacaggcagaagccaggccaggcccctgtggtggtcgtccgtatgatagcgaccggccctcgagggactcccgtgagcgattcctcgtggctccaactcgtagggaacacggcccaccctgaccatcagcgagggtacgaacggccggggatggaacggccgtaactattacgtgtcagggtgtggggggattaggtagtggtgatcattccagtacgtcttcggaactgggaaccaggtccttccgtacctacgttcgagccccgaaggcccaactcgacttcgtcaacgttccc

SEQ ID NO: 432916 - DNA, 719 bp, Homo sapiens
  misc_feature: GZ8MTXP01B9P4H.4.57.F02.1.454.CMB.2.raw
  modified_base (153)..(153): a, c, t, g, unknown or other
  modified_base (227)..(227): a, c, t, g, unknown or other
  modified_base (303)..(303): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcagcccaccctcagtgtcagtcggccccagggcagacggcaggataacgtgtgtggaaccngcagtcgggaaggtaaaagtgtactagttggtacgaggcagaagccaggccacggccctggtggtggtcgtcgtangatacgcgaccggcctcgagggactcccgtgacgcgtactttccgtcgtggcctacccaacgtaccgtacgggaaccaccgggcccaacccgtcgacccaacgcgaacggcgtaaggggaccggaacgggcccgggggatacgggaacgggtacccgtaacgttagttaccgtggtacggtagggtagggttaggggggtaagtttaaggggtaagggttcgggttacggtaattccggtaacttacccgtaacggtttaaccggtaccgtttaaccggggaaacggttaacggggggaaacccttaaacgggggttcccttacccggttacccgtaacccggttaccgaccggaccccgaaacgggtacccctaaaccgtccccgtaacttaccggttcccttcccgtttccccg

SEQ ID NO: 432917 - DNA, 609 bp, Homo sapiens
  misc_feature: GZ8MTXP01CCXPY.4.57.F02.1.454.CMB.2.raw
  modified_base (241)..(241): a, c, t, g, unknown or other
  modified_base (249)..(249): a, c, t, g, unknown or other
  modified_base (302)..(302): a, c, t, g, unknown or other
  modified_base (313)..(313): a, c, t, g, unknown or other
  modified_base (570)..(570): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatgggtgcagttanattggttnatggaaactaacaaattctatgcagactcgtgaaggcattcacatctccaganacaatttcganaacactatttagatactaacagtataaccgaactagtacgtagaaggaaccgacccggaaggaccgtaccggtcttacgttacttagtttagttgtacgagtaaggtaagtaaggtgtacgtaagttcggtttcttacgaccgtagggtcgggaccgaacggtaccggtggtaccaccgtcctcgtacgcgtcctaccacgaaccggtccctacgtcccggtcccttcccgcggtcccgcccgtggcccttaccggngacccgtctaccgtgggcgggcaacgcggcccgtcccgg

SEQ ID NO: 432918 - DNA, 553 bp, Homo sapiens
  misc_feature: GZ8MTXP01ELA5J.4.57.F02.1.454.CMB.2.raw
  modified_base (416)..(416): a, c, t, g, unknown or other
  modified_base (433)..(433): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggagcgtggtccagcctgggggtccctgagactctcctgtgcagcgtctggattcgccttcagtgcctatggcatgcactgggtccgccaggctccaggcaagggggctggaatgggtgcaggttatatggtttgatggaactaaacaaattctatgcagactcgtgaagggcgattcaccatctcagagacaattcgaanaacatatagaatactanagatagaactagtactagagacggaccggagggaacgacggttctcgttacgttaagtttagttgttggacggtaagtaaggttaaggttgggtacgttagttcggtttccgtttaacgg

SEQ ID NO: 432919 - DNA, 535 bp, Homo sapiens
  misc_feature: GZ8MTXP01C7U5V.4.57.F02.1.454.CMB.2.raw
  modified_base (297)..(297): a, c, t, g, unknown or other
  modified_base (313)..(313): a, c, t, g, unknown or other
  modified_base (392)..(392): a, c, t, g, unknown or other
  modified_base (405)..(405): a, c, t, g, unknown or other
  modified_base (434)..(434): a, c, t, g, unknown or other
  modified_base (491)..(491): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataacctgtgtgggaaccagcagtcgggaaggtaaaagtgtacattggtacaggcagaagccaggccaggcccctgtggtggtcgtcgttangatagcgaccggcctnagggactcccgtgagcgattctctcggctcaatcgtggaaacacggccacctgaccatcagcagggtcgaagccgggangagccgatatacngtcaggtgtagggataggggtagtggtanagtcatcccagtacgtcttcggaactcgggaactaagggtcttccgtccttacgtcncgcccgaaggcccaacccactgtccacttctcgttccctaaccc

SEQ ID NO: 432920 - DNA, 526 bp, Homo sapiens
  misc_feature: GZ8MTXP01CYBYV.4.57.F02.1.454.CMB.2.raw
  modified_base (309)..(309): a, c, t, g, unknown or other
  modified_base (389)..(389): a, c, t, g, unknown or other
  modified_base (401)..(401): a, c, t, g, unknown or other
  modified_base (403)..(403): a, c, t, g, unknown or other
  modified_base (429)..(429): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtgccccagggcagacggcaggataacctgtgtgggaaccagcatcggaaggtaaaagtgtacattggacaggcagaagccagccaggcccctgtggtggtcgtcgtatgatagcgaccggcctnagggatccctgagcgattcctctggctccaactctgggaacacggccaccctgaccatcagcaggtcgaaagccggggangacgcatatacngngaggtgtaggggataggtagtggtanatcatactagtacgtcgtacggaacgtcgggaaccgttacggtccttccgtacctacgcgacgacccgaacgcctaacctccacttctccgcgtccg

SEQ ID NO: 432921 - DNA, 507 bp, Homo sapiens
  misc_feature: GZ8MTXP01ELRPC.4.57.F02.1.454.CMB.2.raw
  modified_base (302)..(302): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagccgtgggggtccctgagactctcctgtgcagcgtctggattcgccttcagtgcctatggcatgcactgggtccgccaggctccaggcaaggggctggaatgggtgcagttatatggtttgatggaaactaacaaattcatgcagactcgtgaaggccgatcacatctcaganacaatttcgagaacacaattgaatcacagatgaaacagtctgagaacgccgaagacacggctgtctattatgtgcgagagtaagtgtctatgttctttgaccagtgggacaggaaccgtgtcacgtctcgtcagctccacaacggccatcggtctcccttcggcgccctgcttcgcgacgccaccgtcgtggggcacgcgcgccg

SEQ ID NO: 432922 - DNA, 556 bp, Homo sapiens
  misc_feature: GZ8MTXP01EKQ3X.4.57.F02.1.454.CMB.2.raw
  modified_base (361)..(361): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataaccgtgtgtgggaaccagcagtacgggaaggtaaaagtgtacattggtacaggcagaagcaggccaggccctgtggtggtcgtccgttatgatagcgaccggcctcgagggactccctgagcgattctctcggctcaactcgtgggaaaccncgggccaccctgacccatcagcgagggtcgaaggccgggatggacggcgactattactgtacgagggtgtgggatggggtagtgggtgatcgatccagtacgtcgtcggaacgtcggaccaaggtccttccgtcttacgtcacgttacccgaacggccccaaccctacgtcgtcacttcctcgttccccgtcccc

SEQ ID NO: 432923 - DNA, 552 bp, Homo sapiens
  misc_feature: GZ8MTXP01DBNOB.4.57.F02.1.454.CMB.2.raw
  modified_base (523)..(523): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcagtcggaaggtaaaagtgtacattggtacaggcagaagccaggccaggcccctgtggtggtcgtccgttatgatagcgaccggccctcgagggactccctgagcgtattctctcggcctccaactcgtagggaaaccacggccaccctgacccatcagcgagggtcgaaggccggggatggacggccgatattactgtcgaggtgtagggatagggtaggtggtgatcatcatacgtctcggaactgggaccaagggtcttccggtccacgtcacgaccccgaggaccccaaccccnctcgtccaccttctccgttccccgtcccc

SEQ ID NO: 432924 - DNA, 665 bp, Homo sapiens
  misc_feature: GZ8MTXP01BIJG1.4.57.F02.1.454.CMB.2.raw
  modified_base (590)..(590): a, c, t, g, unknown or other
  modified_base (597)..(597): a, c, t, g, unknown or other
  modified_base (615)..(615): a, c, t, g, unknown or other
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccgccaggcctccgaggcgaaggggctggaagtggggtgctagttatagttggtttgagtaggaaactaaactaaattctaatgacaagacgtccgtaggaaacgggcctattccaacctattcctaccgaagtaagaacctaaagtttaccggaaagtaaaccaactaatttagaaactactaaacgagatacgaacagtctagagaacgaccgaaggacacggcttgtacttaattagtgtgacgaaggagtaagtggtactagttcgtttacgtttgaccgtagggtcgggaccgtacgggtaacccgtggtacccgaccgttcctaccgtcacgtcctacccgaaccgtaacgggccctacgttcccggtcccttccccgnggtcccncccgttgcccttacccgnggaccgtcctacccggtcggtcgggggaccacggccggcccgggtcccgg

SEQ ID NO: 432925 - DNA, 528 bp, Homo sapiens
  misc_feature: GZ8MTXP01BHXL8.4.57.F02.1.454.CMB.2.raw
  modified_base (431)..(431): a, c, t, g, unknown or other
  modified_base (478)..(478): a, c, t, g, unknown or other
  modified_base (489)..(489): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtcggccccaggggcagacggccaggataacctgtgtgggaaccagcatcgggaaggtaaaagtgtacattggtacaggcagaagccaggccaggcccctgtggtggtcgtccgttatgatagcgaccggccctcgaggggactcccgtgacgcggattctctcggctcaactcgtcgggaaaacacgggccaccctgaccatcagcagggtcgaagccgggatcggaggccgacttatacgtgacaggtgngggatagggtagtggtgatcgatcatacgtctggactggacaagtcnccgtcacgtcncgccgagcccaacccatcgtcacttctcgttccccgccc

SEQ ID NO: 432926 - DNA, 531 bp, Homo sapiens
  misc_feature: GZ8MTXP01DT7ZU.4.57.F02.1.454.CMB.2.raw
  modified_base (353)..(353): a, c, t, g, unknown or other
  modified_base (505)..(505): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtgggaaccagcatcgggaggtaaaagtgtacattggtacaggcagaagccaggccaggcccctgtggtggtcgtccgttatgatagcgaccggcctcagggatccctgagcgattctctcggctcaactctgggaaaaccncggccacctgaccatcagcagggtcgaagccggggatgggccgactattactgtcaggtgtgggagtagtaggtggtggatcatccatacgtctcggaacgtggaccaaggtctccgttctacgttcgacgcccaaggcccaacccgaactntcactcgttacttcccaacccgtccc

SEQ ID NO: 432927 - DNA, 570 bp, Homo sapiens
  misc_feature: GZ8MTXP01E1JMR.4.57.F02.1.454.CMB.2.raw
  modified_base (362)..(362): a, c, t, g, unknown or other
  modified_base (427)..(427): a, c, t, g, unknown or other
tcagagcactgtagcacgaccggtgctcgatttagctcgatatagttgggtttggggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacggccaggataacctgtgtggaaccagcagtcgggaaggtaaaagtgtacattggtacaggcagaagccaggccaggcccctgtggtggtcgtccgttatgatagcgaccggccctcagggactccctgagcgattctctcggcctccaactctggggaaaccncgggcccaccctgacccatcagcaggggtacgaaggcccgggggatggacggccgactatttacngtcgagggtggtgggataggggtagtggtgactcatccaattacgttcgtcgggaaacgtcggggaccaaggtccttcccggtccttacgtcacgcccgacggccccaaccccactcgtcaccttctccgttcccctaacccc

SEQ ID NO: 432928 - DNA, 567 bp, Homo sapiens
  misc_feature: GZ8MTXP01C4NH6.4.57.F02.1.454.CMB.2.raw
  modified_base (533)..(533): a, c, t, g, unknown or other
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcactgggtccgccaggctccaggcaaaggggctggaatgggtggctagttatatggtttgatggaaactaacaaattcatgcagactccgtgaaggccattcacatctccagagacaatttcgaagaacacaattgaaatctaacagatgaacagtctagagaagccgaagacacggctgtctattatgtgagagagtaagtggtcagtggttcctttagaccagggtcgggaccaagggtaacccgtggtcctaccgtctcctcacgtccttacccgaccgaacgggcccctacgtccggtcccttcccccgttggcccgcccgtcgccttcccgnggacgccacgtcgcggggcacgcggccgtcccgg

SEQ ID NO: 432929 - DNA, 530 bp, Homo sapiens
  misc_feature: GZ8MTXP01D1EWO.4.57.F02.1.454.CMB.2.raw
  modified_base (228)..(228): a, c, t, g, unknown or other
  modified_base (299)..(299): a, c, t, g, unknown or other
  modified_base (337)..(337): a, c, t, g, unknown or other
  modified_base (414)..(414): a, c, t, g, unknown or other
  modified_base (437)..(437): a, c, t, g, unknown or other
  modified_base (442)..(442): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccngcatcggaaggtaaaagtgtacattggtacaggcagaagccaggccaggcccctggtggtggtcgtcgtangatagcgaccgcctcagggactccctgagcgattcccnctggctccaactcgtgggaacacggcccaccctgaccatcgagcgagggtcgaagccggggatggaggccatatacngcaggtgtagggggataggtagngggtnatcatccatacgtcttcggaactgggaaccaggtccttccgtcctaacgttcacgcccgaagcccaactccacttgtcaaccgttccg

SEQ ID NO: 432930 - DNA, 531 bp, Homo sapiens
  misc_feature: GZ8MTXP01AN8AX.4.57.F02.1.454.CMB.2.raw
  modified_base (408)..(408): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcaggggactcccgtgagcgattctctcggctcaactctggggaaaccacggccaccctgaccatcagcagggtcgaagccgggatgagcgactatacngtcaggtgagggtataggggtagtggtgatcaatcagtacgtcttcggaactcgggacctaaggtccttccggtcacgtcacgcccgacggcccaacccatcgtcacttctcgttcccccgcc

SEQ ID NO: 432931 - DNA, 541 bp, Homo sapiens
  misc_feature: GZ8MTXP01CL01T.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccagcagtcggaaggtaaagtgtacattggtacaggcagaagccaggccaggcccctgtggtggtcgtccgttatgatagcgaccggccctcgagggatcccgtgagcgattccctctggctccaactctgggaacacgggcccaccctgaccatcagcagggtcgaaggccggggatggaggccgatattacgtgtcgagggtgtgggggattaggtagtggtgatcatccatacgtcttacggaactcgggaccaagggtccttccggtcctcgttccgcgccccgaaggcccaactccacttcgtcaacgttcc

SEQ ID NO: 432932 - DNA, 530 bp, Homo sapiens
  misc_feature: GZ8MTXP01EJTEM.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgaagagccgagacacggctgtctatttattgtgcgagagtaagtgtcattgtctttgacgaggtgggcagggggaacctggtcacgtctcctcacgcttccaccaacggcccatccgtcttccccgcgccgccctgccgttcacggcgccaacctcgtcggggccaacgcgcccggg

SEQ ID NO: 432933 - DNA, 560 bp, Homo sapiens
  misc_feature: GZ8MTXP01BXR8S.4.57.F02.1.454.CMB.2.raw
  modified_base (427)..(427): a, c, t, g, unknown or other
  modified_base (530)..(530): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccagcagtcgggaaggtaaaagtgtacattggtacaggcagaagccaggccaggcccctggtggtggtcgtcgtatgatagcgaccggcctcgagggactcccgtgacgcgtattctctcggcctccaactcgtaggggaaaccacgggcccaccctgaccatcagcgagggtcgaaggccggggatggacggccgactattacgngtcgaggtgtgggattagggtagtggtagatcatccatacgtcttcggaacgtgggaccaaggtccttccgtccttagtcgacgacccgacggccccaacccntcgcacttcctaaccgttcccctaaccccg

SEQ ID NO: 432934 - DNA, 607 bp, Homo sapiens
  misc_feature: GZ8MTXP01ELMB3.4.57.F02.1.454.CMB.2.raw
  modified_base (364)..(364): a, c, t, g, unknown or other
  modified_base (405)..(405): a, c, t, g, unknown or other
tcagagcactgtagcacgaccggtgctcgatttagctcgatatagttgggtttggggggaagaggaagactgacggtcctcccaggtgtccagtgtcaggtgcacctggtggaggtcggggggaggcgtggtccagccgtggggggtccctgagactctcctgtgcagcgtctggattcgccttcagtgcctatggcatgcacgtgggtccgccaggctccgaggcaagggggctgggaatggggtgctagttatagtgggtttagagtaggaaactaacaaattctatgcagactcgtagaaggcattcacatctcagagactaattcgaagaacactattagaaatctaacagaatgaaacngtctaggaagacgccgaggacacgggctgtctattatgtgngagagtaagtgtacagttggttctttgaccgaggtcgggaccgacgggggtaaccctgggtaccaccggtcctccgtcgacgtccttcccaaccgaacggcccctagtccggttcccttccccgtcgggcccgtccccgtcgcccgttccgacgggtaacgccgtaaccgtcggtcgggggacctaaccggcggtccccggg

SEQ ID NO: 432935 - DNA, 656 bp, Homo sapiens
  misc_feature: GZ8MTXP01BOM0P.4.57.F02.1.454.CMB.2.raw
  modified_base (294)..(294): a, c, t, g, unknown or other
  modified_base (365)..(365): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccaggcagacgcaggatactgtgtggaaccagcagtcggaaggtaaaagtgtacagttggtacaggcagaagccaggccacggccctggtggtggtcgtccgttangatagcgaccggcctcgagggactcccgtgagcgattctcgtcggcctacaacgtcgtacggggaaaaccnccgggcccacccgtgaacccagtaccgaggccgaacgggggtacgaaacgggcccgggggatcggggaacggtcccggtaactttaagttaaccgtggtaccgtaggggttgggttaggggaattagggggttaggttggggttgatccaagttccctaagttaccggttcgtaccggggaaacgttcggggaacctaagggttccttcccggttaccttacgtccgacgaccccgaacggttaccccaaacccctagtcgtaccacgttccgttcccgttccccgtcccc

SEQ ID NO: 432936 - DNA, 551 bp, Homo sapiens
  misc_feature: GZ8MTXP01BA14L.4.57.F02.1.454.CMB.2.raw
  modified_base (204)..(204): a, c, t, g, unknown or other
  modified_base (366)..(366): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaaggggctggaatgggtgcagttatatggtttgatggaaactaacaaattctatgcagactcgtgaaggccgattcacatctccagagacaatttcgagaacacattgaatctacagatcgaacagtctgagagccgaaggacacgggntgtctattatgtgcgagagtaagtgtcatggttctttgaccgagtcgggcgaggtaccgtggtcaccgtctccgtcagtcctaccaccgaagggccctacgtccggtcccttcccccgttggccccgcccgtcgccttccgcggacgtccaccgttcggcgggggcacgtaacggccggtcccgg

SEQ ID NO: 432937 - DNA, 591 bp, Homo sapiens
  misc_feature: GZ8MTXP01AHQ19.4.57.F02.1.454.CMB.2.raw
  modified_base (488)..(488): a, c, t, g, unknown or other
  modified_base (517)..(517): a, c, t, g, unknown or other
tcagagcactgtagcacgaccggtgctcgatttagctcgatatagttgggcttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcaggacggcaggataacctgtgtggaaccagcagtcgggaaggtaaagtgtacagttggtacaggcaaggaacgccgaggccacggcccctggtggtggtcgtcgtatgatagcgaccgccctcgacgggactcccgtgagcgacttctcgtcggcctccaaactcgtcgggaaccaccgggacccaccctcgaccatcgagcgagggtcgaaacggccgggatcggacgccgtactacttacgtgtacgtagggtggggtaggggtataggtaggttagggtgaacttnaactcctagttaccgtcgtacgggtaacnggggaccgtaacggttcctacccggtccttacgttcacggtccccaaggccctaactccactcgttctaacccg

SEQ ID NO: 432938 - DNA, 539 bp, Homo sapiens
  misc_feature: GZ8MTXP01AIK25.4.57.F02.1.454.CMB.2.raw
  modified_base (250)..(250): a, c, t, g, unknown or other
  modified_base (440)..(440): a, c, t, g, unknown or other
  modified_base (504)..(504): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactggtccgccaggctccaggcaaggggctggaatgggtgcagttatatggtttnatggaaactaacaaattctatgcagactcgtgaaggccattcacatctcagagacaatttcgagaacacattgaatctacagatacgaacagtctgagaagcccgaagacacggctgtctattatgtgcgagagtagtgtcagtgtctttgaccgtagtgggccagggaccctggtccaccgtctcctcncgccttaccgaccgtacgggcccacgtccggtccttccccgttggcccgcccgtggccttccgnggacgccaccgtcggtcggggcacgcgcggcccgg

SEQ ID NO: 432939 - DNA, 599 bp, Homo sapiens
  misc_feature: GZ8MTXP01CHV4B.4.57.F02.1.454.CMB.2.raw
  modified_base (219)..(219): a, c, t, g, unknown or other
  modified_base (465)..(465): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtcggcccaggcagacggcaggataacctgtgtggaaccngcagtcgggaagtaaaagtgtacagttggtacaggcagaagccaggccaggcccctggtggtgtcgtccgtatgatagcgaccggccgtcgaggacgtccctgagcgattctcgtcggctcaactcgtaggaaaccgaccgccgaccctcgaccactacacgacgacgggtacgaaggccggggagtggacggccgaacgtacttacgtgtcgaggtggtgggtaggtaggtaggtaggtgacgtntactaccagtaccgtcgttaccggacgtcgggaaccgaaacgggttccttccggttacccttacgtaccgacgacccgaccggacccaaacccccgacgtcgtctaccgttccgtccgttcccctaaccccccg

SEQ ID NO: 432940 - DNA, 881 bp, Homo sapiens
  misc_feature: GZ8MTXP01BH1T2.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtacattggtacaggcagaagccaggccaggcccctgtggtggtcgtcgtatgatagcgaccggccctcgagggactcccgtggacgcgtactttcccgtcgtcgggcctacccgaaacgttccgtacgggggaaccacccggggaccccaaccccgttcgggaacccctacgttaccgaacgggaccgaacggggggttacccgggaaaacgggccccgggggggtaattacgggggaaccggggtaccccggtaaaccgtttaaacgtttaacccgttcggggttacccggtaaagggggtttcgggtttacggggggggggggtaaactttttaagggggttaaacggggttgggggttttaacggaaacgtttcccgaaacgtttaccccgtaaacgtttaaccccggggtttaccgtttttaaacccgggggaaacccggtttaacggggggtaaaaccccgttaaaacgggggtttccccgtttacccccgggtttaaccccggtttaaaccccgggtttacccggaacccggggttacccccccgaaaaacgggggtcccccctaaaaaccgttccccctaaaccggtttccgggttaaccccgttaaacccgtttttcccccggg

SEQ ID NO: 432941 - DNA, 589 bp, Homo sapiens
  misc_feature: GZ8MTXP01CNAVG.4.57.F02.1.454.CMB.2.raw
  modified_base (223)..(223): a, c, t, g, unknown or other
  modified_base (465)..(465): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggcaggataactgtgtggaaccngcagtcgggaagtaaagtgtacagttggtacaggcagaagccaggccacggccctggtggtggtcgtcgtatgatagcgaccggcctcgaggactcccgtgagcgattctcgtcggctacacgtcgtagggaaaccacggcccaccctgacccatcgacgcgacgggtacgaacggccggggatggacggccgaacttagttacgtgtacgaggtggtagggtagtaggggtaggtgggtanagtcatcctagttaccggtcgttacggaacgtcgggaacctaaggttccttccgtccttacggtaccgacgaccccgacggaccccaacccactcgtacacttcctaaccggttccccgtcccc

SEQ ID NO: 432942 - DNA, 601 bp, Homo sapiens
  misc_feature: GZ8MTXP01B0ZOY.4.57.F02.1.454.CMB.2.raw
  modified_base (300)..(300): a, c, t, g, unknown or other
  modified_base (559)..(559): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacatggtacaggcagaagccaggccaggcccctggtggtgtcgtccgttangatagcgaccggccctcgagggtactccctgacggcgtattccctcgtggcctacccgaaactcgtacgggaaccaccgggccccaccctggaacccatccagcgaggggtacgaagggccggggatagggacgggcccgtaactacgttacgtgtacaagggttggtgggggaattaggtaggtggtgagtcagttcccagttaccgtcgttacggaacgtcggggacccaagggtccttcccggtacctacggttcncgaccccgaaggccccaactcccacttcgtccaacgttcccg

SEQ ID NO: 432943 - DNA, 602 bp, Homo sapiens
  misc_feature: GZ8MTXP01D31M5.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtagggaaccagcagtcgggaaggtaaaagtgtacagttggtacaggcagaagccaggccaggcccctgtggtggtcgtccgtatgatagcgaccggcctcgagggactccctggagcgtacttctcgtcggcctaccaacgtcgtacgggaaaccacgggcccaccctgacccatcagcgagggtcgaaggccgggatggacggcgaatattacgtgtacgaggtggtagggattaggggtagtgggtagatcaacgtcctaagttaccgtcgttaccgggaacgtcgggaacctaacggtccttcccggtaccttaccgtcgacggaccccgaaacgggccccaaccccacgtcgtccaccttccgtcccgttccccctaacccc

SEQ ID NO: 432944 - DNA, 580 bp, Homo sapiens
  misc_feature: GZ8MTXP01AR8EE.4.57.F02.1.454.CMB.2.raw
  modified_base (458)..(458): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacggcaggataactgtgtggaaccagcagtcgggaaggtaaaagtgtacagttggtacaggcagaagccgaggccaggccctggtggtggtcgtcgtatgatagcgaccggcctcgagggtactcccgtgagcgtattctctcggcctcaacgtcgtagggaaacaccggccacccgtgacccatcgagcgagggtacgaaggccggggatggacggcgaactagtacgtgtacgaggtggtagggagtaggggtagtgggtnagtcatccagttccgtacgttacggaacgtcggggaacctaagggtcccttcggtccttacgtacacggacccgaacggccccaacccctatcgtacctaccttctccgttcccctaacccc

SEQ ID NO: 432945 - DNA, 592 bp, Homo sapiens
  misc_feature: GZ8MTXP01BWD3O.4.57.F02.1.454.CMB.2.raw
  modified_base (222)..(222): a, c, t, g, unknown or other
  modified_base (229)..(229): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcaggacggccaggataacctgtgnggaaccngcagtacggaaggtaaagtgtacattggtacaggcagaagccaggccaggcccctggtggtggtcgtccgttatgataggcgaccggccctcgaggggactcccgtgacgcgattcctcgtggcctccaactcgtacgggaaccaccgggcccaccctcgaccatcgagcgagggtcgaagggccggggatggacggcgacttatacgtgtcgagggtggtagggggataggtaggtggtgatcactaccagttaccggtcgttaccgggaacgtcggggaaccaacgggttccttcccggtccgtaaccgttccgcggaccccaagggacccaacgttcccacttcgtccttaactttcccg

SEQ ID NO: 432946 - DNA, 606 bp, Homo sapiens
  misc_feature: GZ8MTXP01EKHSR.4.57.F02.1.454.CMB.2.raw
  modified_base (224)..(224): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccngcagtcgggaaggtaaaagtgtacagttggtacaggcagaagccaggccaggccctgtggtggtcgtcgtatgatagcgaccggcctcgagggactcccgtgagcgtattctcgtcggcctacaacgtcgtacgggaaaacccaccggcccacccgtcgacccagtcgacgcgagggtacgaaaggccggggatggacggaccgtaacttacttaacgtgtacgagggtgtaggggtattaggggtaggtgggtagacttcaacgtcctaagttaccgttcgttacggacgtcgggaacctaaggtccttccgtccttacgtccacgacccgacggacccctaacccgacttcgtccacttccgttccgtttcccccgtccc

SEQ ID NO: 432947 - DNA, 583 bp, Homo sapiens
  misc_feature: GZ8MTXP01AX76Q.4.57.F02.1.454.CMB.2.raw
  modified_base (292)..(292): a, c, t, g, unknown or other
  modified_base (554)..(554): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaagtaaaagtgtacattggtacaggcagaagccaggccaggccctgtggtggtcgtccgtangatagcgaccggcctcgagggactcccgtgacgcgtattcgctcggcctaccaacgtcgtacggggaaaccaccgggcccaccctgacccatcagcgagggtcgaaggcccggggatggacggccgactattacgtgtcgagggtgtaggggtataggggtaggtggtgagtcagtcctagtacgtcgttcgggaacgtcggggaaccaagggtccttccgggtccttacggtccgaacgcccgaacggccccaaaccccgntcgcctacttcctccgttccccaaccccg

SEQ ID NO: 432948 - DNA, 627 bp, Homo sapiens
  misc_feature: GZ8MTXP01EC5VK.4.57.F02.1.454.CMB.2.raw
  modified_base (294)..(294): a, c, t, g, unknown or other
  modified_base (329)..(329): a, c, t, g, unknown or other
tcagagcactgtagcacgaccggtgctcgatttagctcgatatagttgggttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggccaggataacctgtgtggaaccagcagtcgggaagtaaaagtgtacattggacaggcaagaagccaggccaggcccctggtggtggtcgtccgtangatagcgacgcctcgaggactccctgagcgattcnctcggctcaactctacggggaaaccaccgggccacccgtagacccatccaggcgaaggggtcgaaaggccggggaatgggacgccgtactagttacgtgtcgaggtggtagggataggggtaggtggttgaattccaatcccgtaagttaccgtcgtttccggggaaacttcgggggaaccctaaacgggttccgttacccgttacccgttacgtaccgaaccggaccccgaaacgggaccccaaaccccacttccggtccctaacgttcccttcccggtttaaccccctaacccccc

SEQ ID NO: 432949 - DNA, 638 bp, Homo sapiens
  misc_feature: GZ8MTXP01ECQBU.4.57.F02.1.454.CMB.2.raw
  modified_base (348)..(348): a, c, t, g, unknown or other
tcagagcactgtagcacgaccggtgctcgatttagctcgatatagttggggtttggggggaagaggaagactgacggtcctcccaggtgtccagtgtcaggtgcacctggtggaggtcggggggaggcgtggtccagccgtgggggtccctgagactctcctgtgcagcgtctggattcgccttcagtgcctatggcatgcactgggtccgccaggctccgaggcaaggggctggaatgggtgcagttatatggttgataggaaactaacaaattctatgacagactcgagaaggcattcacatctacagagaactaaatttcgaagaacactaattagaaatctaanaagaatagaaacagtctaggaaacgacgcccggagggaacacgggtcttgtacttattagttgtgacgaagagttaagtggtactagttcggttcctttcgaaccgtagggttacggggaccgaacggggggtaacccttgggtacctacccgtcctccgtacgacgtccctacccgtaacccgaaacgggcccctaacgtccggttccccttccccgtcggcccgtcccgtcgcccgttccgacggcgcctaacccggtcggtcgggggacctaaccggcgtccccggg

SEQ ID NO: 432950 - DNA, 702 bp, Homo sapiens
  misc_feature: GZ8MTXP01D6PVQ.4.57.F02.1.454.CMB.2.raw
  modified_base (214)..(214): a, c, t, g, unknown or other
  modified_base (219)..(219): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacgcagatactgtgnggacngcagtcggaaggtaaagtgtacagttggtacaggcagaagccgaggccacggcccctgtggtgtcgtcgtatgatacgcgaccgcctcgagggctcccgtgacgcgtacttcccgtcgtggccctaccaaccgtccgtacggggaaccaccgggacccctacccgtcgaacccatccgaaggtcgaacggggtaccggaaacggggcccgggggtaatcggggaaccgggtacccgtaacgttaacgttaccgtcggtacggtaaggggttgggtaggggggtaattaggggttaaggttggggtagaactccgtaacttccgtaacgtttaccggttccgtttaaccggggaaacgttaacggggaaacccgttaacggggttccccttaccggttacccgttaaccggttccgaacccggaccccgaacgggacccctaaaccgttcccgaacttccgttaacccgttaacgtttcccccg

SEQ ID NO: 432951 - DNA, 595 bp, Homo sapiens
  misc_feature: GZ8MTXP01B6CC3.4.57.F02.1.454.CMB.2.raw
  modified_base (212)..(212): a, c, t, g, unknown or other
  modified_base (290)..(290): a, c, t, g, unknown or other
  modified_base (329)..(329): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacgcaggatactgtgnggaacagcagtcggaaggtaaaagtgtacagtggtacaggcagaagccaggccaggccctggtggtggtcgtcgttangatagcgaccggccctgagggactccctgagtcgattcnctcggcctacaactcgtacgggaaaaccaccgggcccacctgacccatcacgcgaggggtacgaagggccgggagtacggacggaccgacttattaccgtggtcgagggtggtagggtattaggggtaggtggtgagtacagtccagttacggttctacggacgtcgggaacctaacggtccgttccgtaccttacgtacgacgttacccgaacggccccaaccctacgttcgacctaccttccgttaaccgttccccctaacccc

SEQ ID NO: 432952 - DNA, 618 bp, Homo sapiens
  misc_feature: GZ8MTXP01D0OHZ.4.57.F02.1.454.CMB.2.raw
  modified_base (471)..(471): a, c, t, g, unknown or other
  modified_base (593)..(593): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccagcagtcggaagtaaaagtgtacagttggtacaggcagaagccaggccaggccctgtggtgtctcgtatgatagcgaccggcctgagggactccctgagcgtattctcgtggcctacaactcgtaggggaaaccacgggcccaccctgaacccatcaggcgacggggtcgaaaggccggggaatggacggccgaacttagttactggtacgagggtggtaggggtaattaggggttaaggtggggttanagtcgtactccgtaagtaccgttcgtttaccgggaacgttcggggaaccctaaagggttcccttccggtacccttacggtaccacgaccccgttacggacccctaaacccctctcgtacccncgttccttccgttccccttaacccc

SEQ ID NO: 432953 - DNA, 559 bp, Homo sapiens
  misc_feature: GZ8MTXP01A5TS3.4.57.F02.1.454.CMB.2.raw
  modified_base (498)..(498): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagccgtggggggtccctgagactctcctgtgcagcgtctggattcgccttcagtgcctatggcatgcactgggtaccgccaggctccaggcaaggggctggaatgggtgcagttatatggtttgatggaaactaacaaattcatgcagactcgtgaaggcgattcacatctcagagacaatttcgaagaacactaattgaatctaacagatacgaacagtctagagaagccgaaggacacgggctgtctattatgtgcgagagtagtgtctagtgttctttgacgagtcgggacgacgggaccgtggtcaccgtctcctcacgtcttaccgaccgtaacggggaccccacgttccgggtcccttccccgnggcccgcccgtcgccttccgaggttacgcctaccgtcgtacggggcacgtcgcggtcccgg

SEQ ID NO: 432954 - DNA, 544 bp, Homo sapiens
  misc_feature: GZ8MTXP01DCWDP.4.57.F02.1.454.CMB.2.raw
  modified_base (224)..(224): a, c, t, g, unknown or other
  modified_base (298)..(298): a, c, t, g, unknown or other
  modified_base (360)..(360): a, c, t, g, unknown or other
  modified_base (419)..(419): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccngcagtcggaaggtaaaagtgtacattggtacaggcaagaagccaggccaggcccctgtggtggtcgtccgttangatagcgaccggccctgagggactccctgagcgattctctcggcctcaactcgtggaaaccncggccaccctgacccatcagcgagggtcgaaggccggggatggaggccgaactattacnggtcgaggtgtagggattaggggtagtgggtgatcgatccatacgtctcggaactgggaccaaggtcttccgtccttacgtcacgcccgaggcccaacccatcgtcacttctcgttccctaaccc

SEQ ID NO: 432955 - DNA, 559 bp, Homo sapiens
  misc_feature: GZ8MTXP01CN3BI.4.57.F02.1.454.CMB.2.raw
  modified_base (529)..(529): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggataacctgtgtggaaccagcagtcgggaaggtaaaagtgtaacattggtacaggcaagaagccaggccaggcccctgtggtggtcgtcgtatgatagcgaccggcctcgagggactcccgtgacgcgattctcgtcggcctacaactcgtagggaaaccaccgggcccaccctgaaccatcagcgagggtcgaagccggggatggacggccgatatacgtgtcgaggtggagggataggggtaaggtggtagatcgatccattacgtctacggacgtcgggaccaaggtcttccgtcacgtcgacgttcccgacggcccaacccnctcgtccaccttctccgttcccctaacccc

SEQ ID NO: 432956 - DNA, 592 bp, Homo sapiens
  misc_feature: GZ8MTXP01DU33T.4.57.F02.1.454.CMB.2.raw
  modified_base (214)..(214): a, c, t, g, unknown or other
  modified_base (219)..(219): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacgcagatacgtgtgnggacngcagtcggaaggtaaatgtacattggtacaggcagaagccaggccaggcccctggtcggtggtcgtccgttatgatagcgaccggcctcgaggactccctgagcgacttcctcgtggcctccaactcgtacgggaacaccgggcccaccctcgaacccatcacgcgaggggtcgaacggccggggatggacggccgtactagtacgtgtcgagggtggtaggggggaattaggtaaggttgggtgtaacgtcgaacttaccgattaccggtcgttaccggaacgtcgggaaaccttaagggtcccgttccgttacccgtacggttccacggttacccgaacggcctaaccgtccagttcgtccaacgttcccg

SEQ ID NO: 432957 - DNA, 584 bp, Homo sapiens
  misc_feature: GZ8MTXP01BL9LH.4.57.F02.1.454.CMB.2.raw
  modified_base (524)..(524): a, c, t, g, unknown or other
  modified_base (530)..(530): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccgaggcctccgagggcgaagggggctggaatggggtggctagttatagtgggtttgatggaaactaacaaattctatgcagactccgtgaaggccattcacatctccagagactaatttcgagaacacattgaatcacagatacgaaactagtctagagaacgcccgaaggacacgggctgtactattagtgtgcgaaggtagtaaggtgtctagttcggttctttgacgtaggtcgggaccgaacgggtacccgtggtcctaccgtctccctcacgtccttaccaccgtacgggccctacgtccggtccttccccgnggcccncccgtcgccttccgcggcgcctccgtcggcggggccacgccgggccgtcccggg

SEQ ID NO: 432958 - DNA, 757 bp, Homo sapiens
  misc_feature: GZ8MTXP01D4KST.4.57.F02.1.454.CMB.2.raw
  modified_base (215)..(215): a, c, t, g, unknown or other
  modified_base (220)..(220): a, c, t, g, unknown or other
  modified_base (289)..(289): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacgcagatactgtgnggacngcagtcggaagtaaagtgacagttggacaggcagaagccaggccaggccctggtggtggtcgtcgttangatagcgaccggcctcgagggactcccgtgacgcgtattccctcgtcggcctaccaacgttcgacgggaaccgccggcccacccgtcgaaccacgtcgacggtcgaggggtacgaaacggggccggggaatacgggaaccggtacccggtaacttaacgttaaccgtggtacggaaggggttgggttaaggggggggtaaatttaaggggttaagggttcgggggttaagaacgttaccgaactttacccgtaaacggtttaacccgggttacccggtttaaccggggaaaaccgggtttaaccgggggaaaaccccgttaaacgggggtttcccccgtttaccccggggttaaccccgttaaccgggttacccgaaacccgggaaccccccggaaaaccggggtaaccccctaaacccgttaccccgtaaccttccggttaaccccgttaacccttttccccccggg

SEQ ID NO: 432959 - DNA, 806 bp, Homo sapiens
  misc_feature: GZ8MTXP01BXG8W.4.57.F02.1.454.CMB.2.raw
  modified_base (307)..(307): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcaggtcggccccgagggcaggacggccaggactaaccgtgtgtggaaccagcagtacgggaaggtaaaagtgtaacagttggtacaggcagaagccaggccgaggcccctggtggtcggtcgtccgtangataggccgaccggccctcgagggtactccccgtggacgtcgtatttccgtcgtccggccttaccgaaacgtccgtacggggaaaaccctacccgggcccaaaccccgttcgggaaccctaacgtcccgaacgggccgtaacgggggtaccggaaacgggacccgggggtaagtcgggaaccgggacccgtaaccgttaacgtttaacccgtgggttaccgtacggggttagggtacggggtaagtttaacgggggttaagggttggggttaacgtacgttaccgtaacgttaccccgtaagtttaacccggttcgtttaaccggggtaaacgttccgggggaaacccgttaaacgggttcccgttaccccggttaacccgttaacccggttaaccgtaacccgggacccccgaaaacggggttacccccctaaaacccccgtaccgtccggttaccccacgtttccccgttaacccgtttccccccggtaaccccccg

SEQ ID NO: 432960 - DNA, 568 bp, Homo sapiens
  misc_feature: GZ8MTXP01AH9J1.4.57.F02.1.454.CMB.2.raw
  modified_base (173)..(173): a, c, t, g, unknown or other
  modified_base (290)..(290): a, c, t, g, unknown or other
  modified_base (540)..(540): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcagtggcccaggcagacggcaggataacctgtgtggaaccagcagtcggaaggtaaaagtgtacagttggtacaggcagaagccaggccaggccctgtggtggtcgtcgtangatagcgaccggcctcgagggactcccgtggacgcgtattcgtcgtcggcctaccaacgtcgtacggggaaaaccaccgggcccaccctgaccatcgagcgaaggggtcgaaggccggggatggacggccgatattactgtcgagggtgtagggataggggtagtggtagattcgatcagttacgtcttacggaacgtcgggaactaaggtcttccgtccttacgtcacgcccaacggcccaaacccgtntcgtccacgttcctccgttcccaacccc

SEQ ID NO: 432961 - DNA, 749 bp, Homo sapiens
  misc_feature: GZ8MTXP01CP210.4.57.F02.1.454.CMB.2.raw
  modified_base (153)..(153): a, c, t, g, unknown or other
  modified_base (335)..(335): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcacgccaccctcagtgtcaggtcggccccgagggcaggaccggaccgaaggaactaaccgtggtaggtacgggaaaccagacaggtacggaaaggttaaaagtgtaacgtagttaggaacaggacaaggaacgaccgaggccacggccccgtggtggtggtcgtcgtangacgtacggccgaccggcctacgagggactcccgtagacgcgtacttcccgtcgtcggacctaaccgtaacgtcgggtaacgggaacccgacccgggacccctacccgtacggaaccctacgtacgacgggaccggtaacgggggtaccggaaacggggcccgggggtaataccggggaaccggtaccgtaaccgttaagttaccgtacggttacggtaaggggttagggttaggggggtaagttaaggggttaggttaggggtacgaacttcgtaacgttaccgtaacgtttaccgggtaccgtttaacgggaaacggttcgggtaaaccgttaacgggttcccttaccgtccgttaacgacgaccgacccgaacgtacccaacgtcccagttcctccgttaactttccccgg

SEQ ID NO: 432962 - DNA, 553 bp, Homo sapiens
  misc_feature: GZ8MTXP01DB19K.4.57.F02.1.454.CMB.2.raw
  modified_base (341)..(341): a, c, t, g, unknown or other
  modified_base (414)..(414): a, c, t, g, unknown or other
  modified_base (510)..(510): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtgggaaccagcatcggaaggtaaaagtgtacattggtacaggcagaagccaggccaggcccctggtggtggtcgtccgttatgatagcgaccggccctcgagggactccctgacgcgattcccnctggctccaactcgtgggaacacggccacctgaccatcagcagggtcgaaggccgggatggagccgatatacngtcaggtgtgggggatagtagtggtgatcgatccgattaccgtcttcggaacttcgggggaaccttaaaggtccgttccggtccctaacggttccnggaccccaagggtcccaaactcccacgttgtccaaccttcccg

SEQ ID NO: 432963 - DNA, 767 bp, Homo sapiens
  misc_feature: GZ8MTXP01AH5D3.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccaggcagacggcaggatactgtgtggaaccagcagtcgggaaggtaaaagtgtacagttaggtacaggcagaacgccgaggccgacggccctggtggtggtcgtcgttatgatacggccgacccgcctcgacggactcccgtgacgtcgtattctcgtccggcctaccaacgtcgtacggggaaaacccacccgggccctaccccgtacgaaccctacgtaccgaagggaccgggtaacgggggtaccgggaaacggggcccgggggaagtcggggaacgggtacccgtaacgttaacgtttaaccggtggtaccgtaagggggttgggttagggggtaagttaagggggtttaggtaggggttacgtaacttccgtaacgttacccgtaagttacccggttaccgtttaacgggggtaaaccggttaccgggggaaacccggtaaacccggggtttcccgtttccccgggtaacccgttaaccgggtacccgaaaccggacccccgaaaccgggacccccctaaacccgtacgttccgtacccgtaccttcccgttcccgtttcccccgtaaccccc

SEQ ID NO: 432964 - DNA, 589 bp, Homo sapiens
  misc_feature: GZ8MTXP01EJIF3.4.57.F02.1.454.CMB.2.raw
  modified_base (220)..(220): a, c, t, g, unknown or other
  modified_base (341)..(341): a, c, t, g, unknown or other
  modified_base (427)..(427): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataactgtgnggaaccagcagtacggaaggtaaaagtgtacattggtacaggcagaagcaggccaggcccctggtggtggtcgtccgttatgatagcgaccggccctcgagggactccctgagcgattccnctggctccaactcgtcgggaacacgggcccaccctgaaccatcacgcgagggtcgaaaggccggggatggacggccgaatatacgngtcgaggtggtagggggataggtagtgggtacgatcatacccgtattaccggttcgttacgggaacgtggggtaacccttaaagggttcccttccgtaccctacggttccgacggaccccaaacggcccaaacctcccacttcgtaacccaacgtttccccg

SEQ ID NO: 432965 - DNA, 519 bp, Homo sapiens
  misc_feature: GZ8MTXP01C3WZP.4.57.F02.1.454.CMB.2.raw
  modified_base (484)..(484): a, c, t, g, unknown or other
  modified_base (494)..(494): a, c, t, g, unknown or other
  modified_base (497)..(497): a, c, t, g, unknown or other
  modified_base (504)..(504): a, c, t, g, unknown or other
  modified_base (512)..(512): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagccgtggggggtccctgagactctcctgtgcagcgtctggattcgccttcagtgcctatggcatgcactgggtccgccaggctccgaggcaaggggctggaatgggtgcagttatatggttgatggaaactaacaaattctatgcagactcgtgaaggccgattcacatctccagagacaatttcgaagaacacattgaaatctaacagatcgaacagtctgagaagccgaaggacacggctgtctattatgtgcgagagtaagtggtcatggttcctttgaccagtggggaccagggaacctgggtcaccgtctcctcagcttaccacaagggcccatcggtctccccttgccncctgcttcgngancactcgnggggcacncgcgccg

SEQ ID NO: 432966 - DNA, 583 bp, Homo sapiens
  misc_feature: GZ8MTXP01C5MPN.4.57.F02.1.454.CMB.2.raw
  modified_base (149)..(149): a, c, t, g, unknown or other
  modified_base (173)..(173): a, c, t, g, unknown or other
  modified_base (218)..(218): a, c, t, g, unknown or other
  modified_base (288)..(288): a, c, t, g, unknown or other
  modified_base (359)..(359): a, c, t, g, unknown or other
  modified_base (443)..(443): a, c, t, g, unknown or other
  modified_base (468)..(468): a, c, t, g, unknown or other
  modified_base (556)..(556): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcagccaccctnagtgtcagtcggcccaggcagacggcaggataactgtgtggaacngcagtcgggaagtaaagtgtacagttggacaggcagaagccaggccaggccctggtggtggtcgtcgtangatagcgactcggccctgagggactcccgtgagtcgattctcctcggctaccaaactccgacgggaaaccnccgggcccaaaccctggaaccctagacgacgacgaggggtacgaaacggcccgggggatacggacggacccgattagtacgtgnagggtgtaggataggtagtcggtanatcgatccgtaagtcgttcgtacgaacgtcggggaacctaagggttcctccgaccgttacggcaccggccccaaggccccaaacccgntcgtacacctccgttccgttaaccccc

SEQ ID NO: 432967 - DNA, 657 bp, Homo sapiens
  misc_feature: GZ8MTXP01A17J0.4.57.F02.1.454.CMB.2.raw
  modified_base (210)..(210): a, c, t, g, unknown or other
  modified_base (296)..(296): a, c, t, g, unknown or other
  modified_base (371)..(371): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggcccaggcagacgcagatactgngtggaaccagcagtcggaaggtaaaagtgtacattggtacaggcaagaacgccaggccacggcccctggtggtggtcgtccgttangagtacgcgacccggcctgagggactcccgtgacgcgtattccctcgtcggcctaccaacgtcgtacgggaaccnccggcccaccctcgaccctagtcagacgacggggtacgaacgggccgggggatacgggacgggacccgaacgttacgttaacgtcggtacgtaggggttagggtagggggtaagttaggttagggtagggtagtaaacgttccaacgttacccgtaagttacccgggttaccttaccggggaaaccgttcggggaaacccttaacggggttcccttcccgtaccgtaaccgttccgacgaccccgaacggtcccaaaccgtcccacttacgtccttaaccttcccg

SEQ ID NO: 432968 - DNA, 709 bp, Homo sapiens
  misc_feature: GZ8MTXP01DEKNJ.4.57.F02.1.454.CMB.2.raw
  modified_base (149)..(149): a, c, t, g, unknown or other
  modified_base (173)..(173): a, c, t, g, unknown or other
  modified_base (397)..(397): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcagccaccctnagtgtcagtcggcccaggcagacggcaggataactgtgtggaaccagcagtcggaaggtaaagtgtacagttggacaggcagaagcaggccaggccctggtgtggcgtcgtatgatagcgaccggcctcgaggatccctgagcgatctctcggctacaacgtcgtcggaaacgacggcccaccctgaccacacgacgcgtacgggtacgaacggaccggggagngacgggaccgtaaccgttagttaactcggtacgagggttaggtggggtaaagttagggttaagggttccggggtaggtaacgtactaacgttaccctaagttaaaccggttcccggtttaccgggaaaacccggttcggggaaaccccggtaaaacgggtttaccccggttcccggggttacccccttaaaccgggttacccgaacccggaacccccgttaaacccggggaacccctaaaacccccccgaaccgttaacgttccccgaacccgttaccctttccccggttttaaccccccgtaacccccccg

SEQ ID NO: 432969 - DNA, 629 bp, Homo sapiens
  misc_feature: GZ8MTXP01CX7LA.4.57.F02.1.454.CMB.2.raw
  modified_base (213)..(213): a, c, t, g, unknown or other
  modified_base (220)..(220): a, c, t, g, unknown or other
  modified_base (439)..(439): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacgcaggataactgtgnggaaccngcagtcgggaaggtaaagtgtacattggtacaggcagaagccaggccaggcccctgtggtggtcgtccgttatgatagcgaccggccctcgagggactcccgtgagcgtattctcgtcggcctaccaactcgtacgggaaaacccaccgggcccaccctcggacccatcacgcgaggggtacgaagggcccggggatggacggcccgaattacgttacngtcagggtgtaggggtataggggtaggtgggtagagtcaagtccaagttaccggtcgttacggaacgttcggggaacctaaacgggttccttcccggttccttaccggttaccgacggaacccccgaaacgggccccaaaccccctacgtcggtacccaccgttccgttcccgtttccccctaacccccg

SEQ ID NO: 432970 - DNA, 555 bp, Homo sapiens
  misc_feature: GZ8MTXP01DP0H6.4.57.F02.1.454.CMB.2.raw
  modified_base (339)..(339): a, c, t, g, unknown or other
  modified_base (423)..(423): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcgagggactccctgagcgattccnctggctccaactcgtagggaaccacggcccaccctgaccatcagcgagggtcgaaggccggggatcggacggccgatagttacngtcagggtgtgggggataggtagtggtgatcatccatacgtcttacggaacgttgggaaccaagggttccttcccgtaccgtacgttcgacgaccccgaaggccctaaactccacgttcgtccaacgttccc

SEQ ID NO: 432971 - DNA, 607 bp, Homo sapiens
  misc_feature: GZ8MTXP01EFVAI.4.57.F02.1.454.CMB.2.raw
  modified_base (226)..(226): a, c, t, g, unknown or other
  modified_base (297)..(297): a, c, t, g, unknown or other
  modified_base (321)..(321): a, c, t, g, unknown or other
  modified_base (332)..(332): a, c, t, g, unknown or other
  modified_base (359)..(359): a, c, t, g, unknown or other
  modified_base (407)..(407): a, c, t, g, unknown or other
  modified_base (473)..(473): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccaggggcagacggccaggataacctgtgtggaaccngcatcgggaaggtaaaagtgtacagttggtacaggcaagaagccaggccaggccctgtggtgtcgtcgtangatagcgaccggcctgaggctccngagtcgattcnctcggctacaacgtcgtacggaaaccncggcccacctgacccatcgaaggcgaggggtacgacggccggggtaancgggacgccgtaacttagttacgtggtacgaggtgtaggggtattagggggtagtgggtagatacngtcccgtagtaccgttcgttacgggaactcgggaaaccgtaacggtcttaccccgttccgttacgtccaaccggccccgaaagggccccaaccctactcgtaccaccttccgttaaccgtttccccgtaacccc

SEQ ID NO: 432972 - DNA, 625 bp, Homo sapiens
  misc_feature: GZ8MTXP01DDN2V.4.57.F02.1.454.CMB.2.raw
  modified_base (223)..(223): a, c, t, g, unknown or other
  modified_base (323)..(323): a, c, t, g, unknown or other
  modified_base (358)..(358): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcaggtcggcccgagggcaggacggcaggataactgtgtggaaccngcagtcgggaaggtaaaagtgtacattggtacaggcagaagcaggccaggccctgtggtggtcgtccgtatgataggcgaccggcctcgaggactcccgngagcgtattctctcggctcaatcgtagggaaaccncgggtccacctgaccatcagcgacggggtcgaaggccggggatcggaggaccgacttagttactggtacgagggtggtaggggaattagggggtaaggtgggtagatacaacgtccgtaagtaccggttcgttacggggtaactcgggggaaccctaaagggttccttaccggttaccgttacggttaccgaacggacccccgaaagggacccctaaaccccggtacttcggtacccacgtttccttaaccgggttccccgtccccc

SEQ ID NO: 432973 - DNA, 591 bp, Homo sapiens
  misc_feature: GZ8MTXP01DCB43.4.57.F02.1.454.CMB.2.raw
  modified_base (210)..(210): a, c, t, g, unknown or other
  modified_base (283)..(283): a, c, t, g, unknown or other
  modified_base (478)..(478): a, c, t, g, unknown or other
  modified_base (566)..(566): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcagtcggcccagggcagacgcaggataactgngtggaacagcatcggaagtaaagtgtacagttggtacaggcagaagcaggccagccctgtggtggtctcgtangatagcgaccgcctgagggactcccgtgacgcgtattctcgtcggcctaccaactcgtacgggaaaacctaccgggcccaccctgaaccctaagtccaaggacgacggggacgaacgggccggggatcggacggaccgaacgttagttaccgtggtacgagggttgtaggggtattaaggggtacggttgggtanaacgtcaactccgagttaccgtcgttaacggaacgtcgggaacctaaggtccttccggtccttacgcacgacccgacggcccaacccntcgccacttctccggttcccgtccc

SEQ ID NO: 432974 - DNA, 567 bp, Homo sapiens
  misc_feature: GZ8MTXP01AUGF7.4.57.F02.1.454.CMB.2.raw
  modified_base (178)..(178): a, c, t, g, unknown or other
  modified_base (286)..(286): a, c, t, g, unknown or other
  modified_base (329)..(329): a, c, t, g, unknown or other
  modified_base (440)..(440): a, c, t, g, unknown or other
  modified_base (445)..(445): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctnagtgtcagtcgccccagggcagacgcagatactgtgtggacagcagtcggaagtaaagtgtacattggtacaggcagagcaggcaggccctgtggtgtcgtccgttangatagcgaccggccctcgagggactcccgtgacgcgattcccntcggctccgaactcgtagggaacacgggcccaccctgaccatcagcagggtcggaaggccggggatggacggccgtaactagttactgtcgaggtgtgggggataggtagnggtgntcatccagtacgttcgttacggaacgttcgggaaccttaaaggtcccgttcccgtaccgttacgttaccgacgccccgaagggcccctaaccgtcccacgttcgtcccttaaccgtttcccg

SEQ ID NO: 432975 - DNA, 616 bp, Homo sapiens
  misc_feature: GZ8MTXP01C9BN6.4.57.F02.1.454.CMB.2.raw
  modified_base (173)..(173): a, c, t, g, unknown or other
  modified_base (318)..(318): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcagtcggcccaggcagacggcaggataactgtgtggaacagcagtcgggaagtaaaagtgtacattggtacagtcagaagccaggccaggccctggtggtgtcgtcgtatgatacgcgaccggcctcgagggactcccgngacgcgtattctctcggcctcaactcgacgggaaaccaccggccaccctgaccatcacgcgagggtcgaaacggccggggatcggacggaccgaacttattacgtgtcgagggtgtaggggtattagggggttaggttagggtagtactcgaactccgtaagttaccggttccgtttacgggaaaccgttacggggaacccgtaagggttccccttccggtacccgttacgtaccgaacgaccccgacggaccccaacccactccgtacctaccgttccttccgttcccctaaccccg

SEQ ID NO: 432976 - DNA, 525 bp, Homo sapiens
  misc_feature: GZ8MTXP01ESMZY.4.57.F02.1.454.CMB.2.raw
  modified_base (352)..(352): a, c, t, g, unknown or other
  modified_base (408)..(408): a, c, t, g, unknown or other
  modified_base (494)..(494): a, c, t, g, unknown or other
tcagagcactgtagcacgaccggtgctcgatttagctcgatatagttgggtttgggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaggtaaaagtgtacattggtacaggcagaagccaggccaggcccctgtggtggtcgtccgtatgatgcgaccggcctcagggatccctgagcgattcctctggctccaactctgggaacncgggcccaccctgaccatcagcgagggtcgaaggccgggatggaggccgatatacngtcagggtgtggggggataggtagtggtgatctatccagtacgtcttcggaatggggaaccagggtccttaccgtcctacgttcgngcccaaggccaactccacttgtccaacgtcc

SEQ ID NO: 432977 - DNA, 650 bp, Homo sapiens
  misc_feature: GZ8MTXP01C1GEQ.4.57.F02.1.454.CMB.2.raw
  modified_base (217)..(217): a, c, t, g, unknown or other
  modified_base (279)..(279): a, c, t, g, unknown or other
  modified_base (294)..(294): a, c, t, g, unknown or other
  modified_base (377)..(377): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctcagtgtcagtcggccccagggcagacggcaggataacctgngtggaacagaagtcggaaggtaaagtgtacagttggacaggcagaagcaggccaggccctgnggtgtcgtccgttangatacgccgaccggccctcgagggactcccgtggaacgcgtattccgtccgtcggcctcccgaaactcgtaacggggaaaccnccggcccaccctgacccatcgacgcgagggtacgaaaggccggggaatcggacgggaccgacttaacgttacgtggtcgtaagggtgtaggggaattaagggtagggttggtacggatcgtaacgtcccgtaattaccggttcgttaccgggaacgttacggggaacccttaagggttcccgttccgttacccgttacgtcccgaaccggccccaaaacggtccccaaaaccgtccctaacgtcggttaccctaaccgttcccgtttccccgg

SEQ ID NO: 432978 - DNA, 680 bp, Homo sapiens
  misc_feature: GZ8MTXP01B5FU8.4.57.F02.1.454.CMB.2.raw
  modified_base (228)..(228): a, c, t, g, unknown or other
  modified_base (377)..(377): a, c, t, g, unknown or other
  modified_base (638)..(638): a, c, t, g, unknown or other
tcagagcactgtagcacgaccggtgctcgatttagctcgatataggttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcaggacggccaggataacctgtgtgggaaccngcagtcgggaaggtaaaagtgtactagttggtacaggcagaacgccaggcccacggcccgtggtggtcggtcgtccgtatgatcgccggaccggcctggaggactccgtgacgcgtatcgtcgtcggcctacacgtcgtacggaaaccnccggcccacccgtgaacccagtcgacggcgtacggggtacaacgggcggggactagggaccggaccgtaacttacgttaaccgtgggtacgtaggggtggtaacgggtagtaggggttaaggtggggtatacgtacacgttaccgtaaggttaccggttcgttaaccgggaaacgttcgggggaaaccctaagggttcccgttaccgggtcccgttaaacgcccgaacggttaaccccgaacggttacccccaaacccgtnttaacggttcccacctttccgtccccggttcccctaaccccg

SEQ ID NO: 432979 - DNA, 581 bp, Homo sapiens
  misc_feature: GZ8MTXP01DLHVQ.4.57.F02.1.454.CMB.2.raw
  modified_base (223)..(223): a, c, t, g, unknown or other
  modified_base (300)..(300): a, c, t, g, unknown or other
  modified_base (326)..(326): a, c, t, g, unknown or other
  modified_base (366)..(366): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataacctgtgtggaaccngcagtcgggaaggtaaaagtgtacagttggtacaggcaagaacgccaggccacggccctggtggtggtcgtcgttangatagccgaccgcctgaggactcccngagcgattctcgtcggcctaccaactcgtagggaaacccnccgggcccaccctgacccatcgagcgagggtcgaaggccggggatggacgcgaactattacgtgtcgagggtgtagggtattaggggtagtggtagtatcaatcctaagttaaccgtcgttacgggaacgttcgggacctaaggttccttccgtccttacgtccacgaccccgaggaccccaacccactcgtcaccttctccgttcccctaaccc

SEQ ID NO: 432980 - DNA, 676 bp, Homo sapiens
  misc_feature: GZ8MTXP01ETUW7.4.57.F02.1.454.CMB.2.raw
  modified_base (153)..(153): a, c, t, g, unknown or other
  modified_base (224)..(224): a, c, t, g, unknown or other
  modified_base (303)..(303): a, c, t, g, unknown or other
  modified_base (348)..(348): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcacgcccaccctcagtgtcaggtcggccccaggcagacgcagatactgtgaggaaccngcagtacgggaaggtaaagtgtacagttggacaggcaagaacgccgaggccacggccccgtggtggtggtcgtcgttangatcggccgaccgcctcgaggtactcccgtagacgcgtacttccncgtcgcctaccaacgtcgtacgggaacccaccgggacccacccgtacgacctatcgacggacggagggtaccggaacggggaccgggggatacgggaaccggaccgttaaacttaacgttaacctagtacggaaggggttacggtaaggggggtaagtttaagggtaaggttgggtaatacgtacctacgttacccgaagttacccgttaccgttaacgggtaaccggtaacggtaaaccgttaacggttcccgttacccgtaccgtaacgccgaccggaccccgaacggaccctaaacccgtccacgttcgtccttaactttccccg

SEQ ID NO: 432981 - DNA, 571 bp, Homo sapiens
  misc_feature: GZ8MTXP01DPGSL.4.57.F02.1.454.CMB.2.raw
  modified_base (173)..(173): a, c, t, g, unknown or other
  modified_base (209)..(209): a, c, t, g, unknown or other
  modified_base (213)..(213): a, c, t, g, unknown or other
  modified_base (331)..(331): a, c, t, g, unknown or other
  modified_base (402)..(402): a, c, t, g, unknown or other
  modified_base (422)..(422): a, c, t, g, unknown or other
  modified_base (450)..(450): a, c, t, g, unknown or other
  modified_base (539)..(539): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctnagtgtcagtcggcccagggcagacggcaggataacngtgnggaaccagcagtacggaagtaaaagtgtacagttggacaggcagaagcaggccaggccctggtggtggtcgtacgtatgatagcgaccgcctcgagggactcccgtgacgcgtattcncgtcggcctacaacgtcgtacggaaaccacggcccacctgaccatcgagcgagggtacgaaggccgggtanggacgacgaattacttacgngcgaggtggtaggattaggggtgtggtnactacactcgtagtaccgtcgtacggaacgtacgggacctaaggtccttccggtacttacgtacgacgacccgaacggaccccaaaccngtctacctacttcgtcccgttccccgtaaccc

SEQ ID NO: 432982 - DNA, 533 bp, Homo sapiens
  misc_feature: GZ8MTXP01C07NV.4.57.F02.1.454.CMB.2.raw
  modified_base (305)..(305): a, c, t, g, unknown or other
  modified_base (357)..(357): a, c, t, g, unknown or other
  modified_base (423)..(423): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggagcgtggtccagcctgggggtccctgagactctcctgtgcagcgtctggattcgccttcagtgcctatggcatgcacgtgggtcccnccaggcctccgaggcgaagggggctggaagtgggtgctagttatagtggttnagtggaaactaaactaattctatgcagactcgtgacggccatcacatctccagagactaattcganaacactacttggaatctacagatacgaacagtactgaagacgaccggagaacaacggctgttcttattgttgttgacgaagtagtaagtgtcagtcgttccgtttaacgg

SEQ ID NO: 432983 - DNA, 710 bp, Homo sapiens
  misc_feature: GZ8MTXP01BAOL5.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtacattggtacaggcagaagccaggccaggccccctggtggtggtcgtccgttactgagtagtcgacccggcccgtccagggacgtccctcgagcgagttctctcgcgtcactctggaaacgacgccgaccctacgaccgactcacgacgacgggtacggaacggaccgggggacgtaggacgggccggaaccgttaacgtttaacgtcgtccgaagggttggtaggggtaagttaaggggttaaggttgggttaggagtacgtacgtaccctaagttaaccggttccgtttaccgggtaaaccgttacgggggtaacccggtaaacgggttcccgttccccggttacccgttacccggttacccgtaaccggacccccgaaaccggggttaccccgaaaaccccccacccgttcggtaccctaacccggttacccttcccggtttccccccgttaacccccccg

SEQ ID NO: 432984 - DNA, 567 bp, Homo sapiens
  misc_feature: GZ8MTXP01AHTTS.4.57.F02.1.454.CMB.2.raw
  modified_base (289)..(289): a, c, t, g, unknown or other
  modified_base (357)..(357): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaagtaaaagtgtacattggtacaggcagaagccaggccaggccctgtggtgtcgtcgtangatagcgacggccctcgaggactccctgacgtcgattctctacggctaccaactcgtggggaaaaccncgggcccacccgtgacccatcgagcgaacgggtcgaaacggccggggatggacggaccgtactattacgtgtacgaggtgtaggggtataggggtagtggtcgatcgactccattacgtcgtcgaaccgtgggaccctaaggtcttccggtccttacgtcacggcccaaacggcccaaaccccatcgacacttctcgttcccctaacccc

SEQ ID NO: 432985 - DNA, 511 bp, Homo sapiens
  misc_feature: GZ8MTXP01DJIMU.4.57.F02.1.454.CMB.2.raw
  modified_base (409)..(409): a, c, t, g, unknown or other
  modified_base (419)..(419): a, c, t, g, unknown or other
  modified_base (472)..(472): a, c, t, g, unknown or other
  modified_base (484)..(484): a, c, t, g, unknown or other
  modified_base (508)..(508): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagcaggccaggcccctgtggtgcgtccgtatgatagcgaccggcctcgagggactcccgtgagcgattccctctggctccaactcgtagggaacacggccaccctgacccatcagcagggtcgaagcgggatggagccgatatacngtcaggtggngggggataggtagtggtgatcatccatacgtctcggaactgggaccaggtccncgtctacgttcngcccaaggccaactccacttgtcnctc

SEQ ID NO: 432986 - DNA, 656 bp, Homo sapiens
  misc_feature: GZ8MTXP01EJNYP.4.57.F02.1.454.CMB.2.raw
  modified_base (293)..(293): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacgccaggatactgtgtaggacagcagtcggaagtaaagtgacagttgacaggcagaagccaggccacggcccctggtggtggtccgtccgttangatacgccgaccggcctacgacggactcccgtagacgcgactttcctcgtcggcctacccgaaactcgtacgggaaccacccgggcccaacccgttcggaaccctactaccgacggccggtaaggggtaccggaaagggtcccgggggaatacgggaaccggggcctaaacgttagttaacgcggtacggaagggttgggagggggtaattagggtagggttggacgtagtacctacgtacctagttaacccggttcgttaaccgggaacgtcgggtaaccttaacgggttcccttaccggtaccttaaccggcgttaccgacccgtaacggcctaaactcccgattcgtccaaccgtttccg

SEQ ID NO: 432987 - DNA, 644 bp, Homo sapiens
  misc_feature: GZ8MTXP01EFPVW.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccgccaggcctccgaggcgaaggggctggaagtggggtggctagttatagttggtttgataggaaactaaacaaattctaatgcagactcgtagaacggcatcacatctcagagactaatttcgaagaaacactaatttagaaattactaacgagatacgaaacagtctagaagaacgacccgaaggacacgggtctagtacttattagttgtgacgagaagtaagtggtactagttcggttacctttgaccgtaggtcggggaaccgtaaacgggtaacccggttggtaccgtacccgttcctcccgtcgacgtccttacccgaaccgtaacgggccctacgtcccggtcccttccccgttggcccgttcccgtcgccgttaccgacggaccgccctaccgttcggcgggggaccaaccgcgggttcccggtcccggg

SEQ ID NO: 432988 - DNA, 605 bp, Homo sapiens
  misc_feature: GZ8MTXP01BWQAP.4.57.F02.1.454.CMB.2.raw
  modified_base (341)..(341): a, c, t, g, unknown or other
  modified_base (423)..(423): a, c, t, g, unknown or other
  modified_base (454)..(454): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggatacctgtgtggaaccagcagtcggaaggtaaaagtgtacattggtacaggcagaagccaggccaggcccctggtggtggtcgtccgttatgatagcgaccggcctcgagggactcccgtgagcgattccnctggctccaactcgtagggaacacgggcccaccctgaccatcagcgagggtcgaaggccggggatggacggccgatattacngtacaggtgtgggggattaggtagtgggtanagtcatcctaagtaccgttcgttacgggaacgttaacgggggaacccttaaaggggttcccttcccggttacccgtaccggttccgacgaccccgaaaacgggcccctaaaaccgttcccgaacttcgtaaccgttaacccgttttccccg

SEQ ID NO: 432989 - DNA, 668 bp, Homo sapiens
  misc_feature: GZ8MTXP01DYNL6.4.57.F02.1.454.CMB.2.raw
  modified_base (173)..(173): a, c, t, g, unknown or other
  modified_base (626)..(626): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtaacctcatatgtgctgactcagccaccctnagtgtcagtcggccccagggcagacggccaggataacctgtgtgggaaccagcagtcgggaaggtaaaagtgtaacattggacaggcagaagccaggcaggccctgtggtggtcgtcgttatgatagcgacccggccctcgagggactcccgtgagcgtattctcgtcggccctaccaaactcgtacgggaaccaaccgggcccaacccgtgacccatcgagcgaggggtacgaacgggccggggaatcgggacggccgtaacgttaacgttaccgtggtacgagggttggtagggtaatagggttaggggtaggttagtaacttacacgttaccgtaacgttacgttaccgttaaccgggtaacgttacggggaacccgtaacgggttcccttcccggttaccgtaccggttaccgaaaccggaccccgaaaaccggccccaaaaccccctntaccgtccctacctccgttcccgttcccccgcccctttcccc

SEQ ID NO: 432990 - DNA, 645 bp, Homo sapiens
  misc_feature: GZ8MTXP01D4H6B.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccgccaggctccgaggcaaggggctggaatgggtgctagttatagtggtttgataggaaactaacaaattctaatgacagactcgtagaaggccattcaccatctacagagactaattcgaagaaacacaatttgaaattctaacagatacgaaactagtctgaacgaacgaccgaagggaacacgggtcttgtacttagttagttgtgacgaagtagtaaggtggtactagttcggttctttagaccgtagggtacggggaccgtaacggggtaacccgtcggtaccgtaccgttccgtaccgtcgtacgtaccttaccgaaccgtaacgggtaccctacgttcccggtcccttcccccgttcggtcccgttcccgtcgtccttccgacggacgaaccgtacccgttcggcgggggaccacggcggttccgggtcccgg

SEQ ID NO: 432991 - DNA, 727 bp, Homo sapiens
  misc_feature: GZ8MTXP01CLPBI.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctcagtgtcagtcggccccagggcagacgcaggataacctgtgtaggaaccagcagtacggaaggtaaaagtgtacagttggacaggcaggaagccgaggccacggcccctggtggtcggtcgtcgtatgatacgcgaccggcctcgagggactccgtgacgtcgtacttcccgtcgtcggcctaccctaacgtccgtacgggaacccacccgggaccccaaccccgtacgaacccaacgtccgaacggaccggtaacgggggtaccggaaaccggggtcccgggggaagttacggggaacgggtaaccccgtaacgttaacgtttaaccggtcggtacggtaggggttagggtagggggtaagttaagggttaggtagggtacgtacgttaccgtaacgttaccgtaacgttaccggttaccggttaaccgggtaaccggtaaccggggtaaccgttaaccgggttcccgttacccgtaccgtaaccgttaccgaccgaaccccgaaccgacccttaaccgtccctacgttaccgtaaccgttccgttcccg

SEQ ID NO: 432992 - DNA, 669 bp, Homo sapiens
  misc_feature: GZ8MTXP01DS7G5.4.57.F02.1.454.CMB.2.raw
  modified_base (300)..(300): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccgaggcgaaggggctggaatgggtgctagttatagtggttgatggaaactaacaattctatgcagactcgtgaaggcatcacatcncagagactaatttcgagaacactattgaatctaacagatacgaactagtctagagaacgacgaagacacggtctgtactattagtgtagacgagtagtaagtgttacgtagttcggtttcctttaggaccgtagggtcggggacccgaacggggtacccggttacggtaccgtacccgtcgttcccgtaccgacggtacccttacccgaaccgtaaccgggtcccctaacgttcccgggttaacccctttcccccggttgggtccccgttccccgttcggtcccttaacccggcgggttaaaccgtccctaacccggttccgggtaccggggggaccttaacccggccgggttccccgggttccccggg

SEQ ID NO: 432993 - DNA, 651 bp, Homo sapiens
  misc_feature: GZ8MTXP01DQL0P.4.57.F02.1.454.CMB.2.raw
  modified_base (178)..(178): a, c, t, g, unknown or other
  modified_base (221)..(221): a, c, t, g, unknown or other
  modified_base (294)..(294): a, c, t, g, unknown or other
  modified_base (358)..(358): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgccaccctnagtgtcagtcggccccagggcagacgcagatactgtgaggacngcagtcggaaggtaaagtgtacagttggtacaggacagaagccgaggccaggcccctggtggtgtcgtcgtangatacgcgaccggcctcgaggactcctgagcgattccacgtggctaccaactcgtacgggaacncggaccacctgaccatcgagcgaagggtacgaaacggccggggatcgggacggtaccgtaacttaacgttacgcggtacgaaggggttgggtaaggggggttaataaggggttaggttacgggtagtaactacgacgttaccctaagttaccgttaccgttaccgggaacgtaacggggtaaaccgttaacgggttcccttcccggtaccgttaacggttacccgaacgacccccgaaagggtaccccaaaacccggtttcccaaccggttcttccccggaacgttttccccg

SEQ ID NO: 432994 - DNA, 604 bp, Homo sapiens
  misc_feature: GZ8MTXP01DTWAY.4.57.F02.1.454.CMB.2.raw
  modified_base (223)..(223): a, c, t, g, unknown or other
  modified_base (303)..(303): a, c, t, g, unknown or other
  modified_base (377)..(377): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggcaggataactgtgtggaaccngcagtcggaaggtaaaagtgtactagttggtacaggacaagaacgccgaggccacggcccctggtggtggtcgtcgttangataggccgacccggcctcgagggactcccgtggagcgtattctcgtcggcctaccaactcgtagggaaaaccncggcccaccgtgaccatcgagcgagggtacgaaggccggggatggacggactaacttagttacgtggtacgagggtggtagggtatagggggttagtggtagactcgatccaagtaccgttcttaccgggagttcgggaacctaaggttccttccggtaccttacggtacacggacccgaacggaccccaacccctagtcgtaccacttcctccgttccccaacccc

SEQ ID NO: 432995 - DNA, 725 bp, Homo sapiens
  misc_feature: GZ8MTXP01CA470.4.57.F02.1.454.CMB.2.raw
  modified_base (173)..(173): a, c, t, g, unknown or other
  modified_base (297)..(297): a, c, t, g, unknown or other
  modified_base (327)..(327): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcaggtcggcccagggcaggacggcaggactaactgtgtaggaaccagcagtcgggaaggtaaaagtgtaacattggtacaggcagaagccaggccaggccctggtggtggtcgtcgtangatgcgaccggcctcgagggactccctggngcgtattctctcggctcaacgtcgtgggaaaccaccgggcccacccgtgacccagtccgacggcggaacgggggtccggaaaggggtcccgggggaagtcgggaacgggtcccggtaaacttacgttaacgttcgggtacgtaggggttgggtagggggtaagttagggggttaggggttggggtacgtaggtacctacgttacccgtaagtttaccggttcggttaccggggaaaccggttcgggggaaacccgttaaacgggggttccccttacccgggttaccccgttacgggtacccgtaaccgggacccccgaaccggggaacccccaaacccccggtacgttccggtacccgtaccttcccgttaaccccggtttccccccgtaaccccccg

SEQ ID NO: 432996 - DNA, 604 bp, Homo sapiens
  misc_feature: GZ8MTXP01BZK5O.4.57.F02.1.454.CMB.2.raw
  modified_base (263)..(263): a, c, t, g, unknown or other
  modified_base (488)..(488): a, c, t, g, unknown or other
tcagagcactgtagcacgaccggtgctcgatttagctcgatatagttgggtttggggggaagaggaagactgacggtcctcccaggagttcaggtgctgggcaccgtgggcagtggggggaggcgtggtccagccgtggggggtccctgagactctcctgtgcagcgtctggattcgccttcagtgcctatggcatgcacgtgggtccgccaggctccgaggcgaagggggctaggaagtggggtgctagttatagtggtttnataggaaactaacaaattctatgcagactcgtagaacggcatcacatctacagagactaattcgaagaacactattagaaatctaacagaatacgaactagtctagagaacgaccgaaggacacgggtctagtacttattagtgtgacgaagtagtaagtggtactagttcggttactttagacgaggtcgggaccgaacgggaccgtcggtcctaccgtctccncgtacgccttaccgaccgtaacggccctacgtccggtcctccccgttcggcccgccgtcgccttccgcggttaccgccgtaccgtcggtcgggggcacggccggttccggtcccgg

SEQ ID NO: 432997 - DNA, 598 bp, Homo sapiens
  misc_feature: GZ8MTXP01BASZ2.4.57.F02.1.454.CMB.2.raw
  modified_base (362)..(362): a, c, t, g, unknown or other
  modified_base (552)..(552): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgtatgatagcgaccggccctcgagggtactcccctgacgcgattccctctggctccaactctgggaacncgggcccaccctgacccatcacgcgaggggtacgaaagggcccgggggaatggacgggcccgtacgtaacgttaccgtgtccgagggttggtggggggtaagtagggtagtcgggttgacttcaagttcccagttacgtccttacgggaacgttggggaaccaagggtccttcccggttcctacgttccngcccccaagggccccaaccttcccacttcgtccttaacgttccccg

SEQ ID NO: 432998 - DNA, 621 bp, Homo sapiens
  misc_feature: GZ8MTXP01DUMCN.4.57.F02.1.454.CMB.2.raw
  modified_base (215)..(215): a, c, t, g, unknown or other
  modified_base (222)..(222): a, c, t, g, unknown or other
  modified_base (291)..(291): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggcccagggcagacggcaggataactgtgnggaaccngcatcggaagtaaagtgtacattggtacaggcaagaagccaggccaggccctggtggtggtcgtcgtangatagccgaccggcctgagggactcccgtgagcgtattctcgtcggcctaccaacgtcgtacgggaaaccacggcccaccctgacccatccaggcgagggtacgaaggccggggatcgggacggaccgaacttacgttactggtacgtaagggtggtaggggtattagggggttaggtgggttagatcactccgaagttaccggttcgttacgggaacgtcgggaacctaaagggttcccaccggttcccgttacgggtacaccggttaccccgaacgggaccccctaaccccacgtcgtaccaccgttcttcccggttcccccgtcccc

SEQ ID NO: 432999 - DNA, 548 bp, Homo sapiens
  misc_feature: GZ8MTXP01DL5CS.4.57.F02.1.454.CMB.2.raw
  modified_base (293)..(293): a, c, t, g, unknown or other
  modified_base (422)..(422): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggataactgtgtggaaccagcagtcgggaaggtaaaagtgtacagttggtacaggcagaagccaggccaggccctgtggtggtcgtcgtangatagcgaccggcctcgagggactcccgtgagcgattctctcggcctccaactcgtagggaaaccaccgggcccaccctgacccatcagcgagggtcgaaggccggggatggaggccgaactattacgngtcgaggtgtgggatagggtagtggtgatcatccatacgtctacggacgtgggactaaggtccttccgtcacgtcacgacccgacggcccaacccactcgtccacttcctccgttcccctaacccc

SEQ ID NO: 433000 - DNA, 746 bp, Homo sapiens
  misc_feature: GZ8MTXP01ASWWT.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtgggaggtcgggggggaggcgtggtccagccgtggggggtccctgagactctcctgtgcagcgtctggattcgccttcagtgcctatggcatgcacgtgggtccgccaggctccgaggcgaaggggctagggaagtggggtggctaggttatagttgggtttagataggaaactaaactaaattctaatgacagacgtccggtaggaacgggcctaattccacctatcctaccaagaacgaactaagtttacgaagaaaccactaagttagaaactctaaacaggtaactaggaaactagtcctaggaaacggacgcccggaaggtaacccgaccgggtcttaggttacttaaagtttagttggtacggacggtaaggtaaggtaaggttggtacgtagtttcggttcccgtttagaaccggtaggggtcgggggtaccgaacgggggggtaaccccgtggggttaccctacccggttcctacccgtacgtaccgtaccctaccccgaaccggtaaccgggtcccctaacggttcccggtttccccttccccggtcgggccccgtacccgtcgcccgttaccgacgggtaacgcccgtaaccggtcggggccggggacctaaccggccgggcccggg

SEQ ID NO: 433001 - DNA, 547 bp, Homo sapiens
  misc_feature: GZ8MTXP01ANFBL.4.57.F02.1.454.CMB.2.raw
  modified_base (420)..(420): a, c, t, g, unknown or other
  modified_base (523)..(523): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccagcatcggaaggtaaaagtgtacattggtacaggcagagccaggccaggccctgtggtgtcgtccgtatgatagcgaccggccctgagggactcccctggacgcgattctcgtcggcctccaatccgtaggggaaaccaccgggcccaccctgaccatcagcgagggtcgaagccggggatggagccgactattacngtcgagggtgtagggataggggtagtgggtagatcatccaagtaccgtcttcggaactgggacaaggtcttccggtcttacgcacgcccaggcccaaccccgntcgtcacttctcgttccccaaccc

SEQ ID NO: 433002 - DNA, 629 bp, Homo sapiens
  misc_feature: GZ8MTXP01A84HN.4.57.F02.1.454.CMB.2.raw
  modified_base (297)..(297): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccgagggcaggaccggccaggataacctgtgtaggaaccagcagtacggaaggtaaagtgtacattggacaggcagagcaggcacggccctggtggtggtcgtcgttangatcgccgaccggcctagacgggactcccgtggacgcgacttctcgtccggcctaccgaacgtcgacgggaaacacgtccggacccctaacccgtcgacccagtcgaaggccgtacgggggtacgaaacggggccggggatcgggacggtaccgtacttagtacggtgacgtagggtggtagggagttaggtaggtcggggtagactcgacgttccgaaagttccgtacgttacggacgtacgggaacctagggttcctcccgttcgtaccgtccaccggccaaccggaaccccaaccccgtgtccgtccttacctccgttccggttccccc

SEQ ID NO: 433003 - DNA, 571 bp, Homo sapiens
  misc_feature: GZ8MTXP01AUICH.4.57.F02.1.454.CMB.2.raw
  modified_base (254)..(254): a, c, t, g, unknown or other
  modified_base (316)..(316): a, c, t, g, unknown or other
  modified_base (387)..(387): a, c, t, g, unknown or other
  modified_base (400)..(400): a, c, t, g, unknown or other
  modified_base (526)..(526): a, c, t, g, unknown or other
tcagagcactgtagcacgaccggtgctcgattagctcgatatagttgggtttggggggaagaggaagactgacggtcctcccaggagttcaggtgctgggcaccgtgggcatgggggaggcgtggtccagccgtggggggtccctgagactctcctgtgcagcgtctggattcgccttcagtgcctatggcatgcactgggtccgccaggctccgaggcgaaggggctggaatgggtgcagttatagtggtttnatggaaactaacaaattctatgcagactccgtgaaggcatcacatctcagagactattcganaacacatagaatctacagatacgaacagtctgagaacgccgaaggacaacgggtctgtactattactgtgngagtagtagtgtnagttgtctttagacgtaggtcgggacgacgggtaaccgttcgggtcctaccgtctcctcgacgtcctaccaccgtaacggccctacgtccggtccttccccgcggtccgcccgtcgccgttcccgnggttacgccgtaccgtcggtcggggcaccgtcgggccggtcccgg

SEQ ID NO: 433004 - DNA, 636 bp, Homo sapiens
  misc_feature: GZ8MTXP01CG0F1.4.57.F02.1.454.CMB.2.raw
  modified_base (172)..(172): a, c, t, g, unknown or other
  modified_base (362)..(362): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctnagtgtcagtcggcccaggcagacgcagataactgtgtggaaccagcagtcggaaggtaaaagtgtaacagttggtacaggcagaagccgaggccacggccctggtggtggtcgtcgtatgatagcgaccggcctcgagggactcccgtgacgcgtactctctcggcctacgaacgtcgtacgggaaaccnccggcccaccgtacgaccatcgacgcggacgggtacgaacgggccggggaatcgggacggccgtaacttattacgtcggtacgagggtggtagggtattagggggtagtgggtgaacgtacgagtaccgtagttaccgtcgttacgggaaacgtcgggaaccctaaaggttcccttccggttaccttaccggtaccgacgaccccggttaacggttacccccaacccctacgtcgtccctaaccgttccgttcccgttaaccccgtaacccccg

SEQ ID NO: 433005 - DNA, 732 bp, Homo sapiens
  misc_feature: GZ8MTXP01ARO1E.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtaacctcatatgtgctgactcagccaccctcagtgtcagtcggccccagggcagacggcaggataacctgtgtggaaccagcagtcggaaggtaaagtgtacagttggacaggcagaagccaggccacggccctggtggtggtcgtcgttatgatagcgaccggcctcgagggctcccgtgacgtcgtattctcgtcggtcccctaccgaaacgtccgtacgggggaaacccaacccgggcccctaacccgtggaacccaagttccgaagggccggaaacgggggttaccgaaacggggcccggggggtaatcggggaacgggtacccgtaacgttaagttaccgtggtacggtaaggggttcgggtagggtaagttaagggtaggggttgggtacggtatacggtaacttacccgtaagtttaccggttccgttaacgggtaaaccggttacggggtaaacccgtaacgggttcccgtacccggttacccgttaccggttaccgaaccggaaccccgaacccggttacccccaaaccccgtaactccgtaacctaccgttccgttcccgttccccgccctttaaccccg

SEQ ID NO: 433006 - DNA, 554 bp, Homo sapiens
  misc_feature: GZ8MTXP01E16TN.4.57.F02.1.454.CMB.2.raw
  modified_base (360)..(360): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcgagggactccctgagcgattcctctggctccaactctgggaacnccggccaccctgaccatcagcgaggggtcgaacggccggggatggacggccgatattacgtgtacagggtgtagggggataggtagtggtgatcatcagtacgtcttcgggaacgtgggaaccaaagggtccttccggtcctaacgttcgacgccccaagggccctaaacgtcccacttcgtccaaccgttccc

SEQ ID NO: 433007 - DNA, 710 bp, Homo sapiens
  misc_feature: GZ8MTXP01EGPJS.4.57.F02.1.454.CMB.2.raw
  modified_base (295)..(295): a, c, t, g, unknown or other
  modified_base (300)..(300): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcaggtcggccccagggcagacggccaggactaactgtgaggaaccagcagtacggaaggtaaagtgtactagttggtacaggcaagagccaggccaggccctggtggtgtcgtcgtntaganagtccgaccggccgtcgaggactcctcgagcgacttctcgtccggctaccaacgtacgtacggaaaccgaccggcccgacccgtacgacccactacacggacggaacgggtacggaacgggaccggggagtacggacggaccggtaacttacgttaacgtcggttacgaggggttaggtaggggtacggttaaggggttacggttaggggttaccgtaggttactaaaccgtctaaacgttacccggttacgttaccggggtaacgtaccggggtaacccgtaaacgggttcccgttccccggtacccgttaacgtccggtaaccgaccccgaaacccgggaccccaaacccccggtaacgtccgtacccgttaccttacccggtttccccgttaacccccgtaaccccc

SEQ ID NO: 433008 - DNA, 547 bp, Homo sapiens
  misc_feature: GZ8MTXP01CWC8D.4.57.F02.1.454.CMB.2.raw
  modified_base (346)..(346): a, c, t, g, unknown or other
  modified_base (437)..(437): a, c, t, g, unknown or other
tcagagcactgtagcacgaccggtgctcgatttagctcgatatagttgggttgggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactcgtgaaggccgattcaccatctccagagacaattcgagaacacatgaatctacagatgaacagtctgagagccgaggacacggctgtctattattgtgcgagagtaagtggtcatggtccttttgaccngtgggccagggaccctggtcaccgtctcctcagcttccaccgaacgggcccagtccgtcttccccctggccgccctcgcgtcccgaggacnccacctcgtcgggggccacgacgccggcccgtcggggctcggcccgttgggtcaaacgggtacctaccttccccgttacacgtgctcgtggacgcgggtcttgggaaccg

SEQ ID NO: 433009 - DNA, 635 bp, Homo sapiens
  misc_feature: GZ8MTXP01A9NE5.4.57.F02.1.454.CMB.2.raw
  modified_base (211)..(211): a, c, t, g, unknown or other
  modified_base (366)..(366): a, c, t, g, unknown or other
  modified_base (606)..(606): a, c, t, g, unknown or other
tcagagcactgtagcacgaccggtgctcgatttagctcgatatagttgggtttggggggaagaggaagactgacggtcctcccaggtgtccagtgtcaggtgcacctggtggaggtcggggggaggcgtggtccagcctggggggtccctgagactctcctgtgcagcgtctggattcgccttcagtgcctatggcatgcacgtgggtccnccaggctccaggcgaaggggctggaatggggtggctagttatagtggtttgataggaaactaaacaaattctatgacagactcgtagaacgggccattcaccatctccagagactaatttcgagaacactattagaatctaacagactagaaacngtctagaaagacgccggaggaccgacggtctagttacttaagtttattggtgacggaaggtaggttaaaggtggttacgagttcggtttccttttagaccgtagggttcggggacctaggggtacggaacccgttggtacctaccggtcctccgtcgacgtccttaccgaaccgtaacgggccctaacgttccggttccccttccccgttggcccgtcccttcgccgttaccgaaggacnccgtaccgtcggcggggccaacggccggg

SEQ ID NO: 433010 - DNA, 701 bp, Homo sapiens
  misc_feature: GZ8MTXP01D3SXG.4.57.F02.1.454.CMB.2.raw
  modified_base (336)..(336): a, c, t, g, unknown or other
  modified_base (452)..(452): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcgggaaggtaaaagtgtacattggtacaggcagaagcaggccaggccctggtggtggtcgtcgtatgatagccgaccggcctgagggactcccgtgagcgattcncgtcggcctaccgaacgtcgtacgggaaacccaccgggcccacccgtgaacccatccgaggcgaaggggtacggaagggccggggatcgggaacggcccgtaacttagtttaccgnggtacgagggttggtaggggtagttagggggttaaggttggggtacgtagtcgtaacgttcctaacgtttaccggttacgttaccggggaaaccgttcgggggaacccctaaacggggttccccttaccccgggttacccttaccgggtacccgaaccggttacccccgaaaccggggttacccccaaaacccccgtcgttaaccgtaccctacccgttccgtttccccggtttcccccgtaacccccc

SEQ ID NO: 433011 - DNA, 702 bp, Homo sapiens
  misc_feature: GZ8MTXP01AGHL7.4.57.F02.1.454.CMB.2.raw
  modified_base (312)..(312): a, c, t, g, unknown or other
tcagagcactgtagcacgaccggtgctcgatttagctcgatatagttggggtttggggctgggcctaaggaagcagcactggtggtgcctcagccatggcctggaccgttctcctcctcggcctcctctctcactgcacaggctctgtgacctcatatgtgctgactcacgccaccctcagtgtcaggtcggccccagggcaggaccggcaggataaccgtgtgtaggaaccagcagtacgggaaggtaaagtgtacagttggacaggcaagaagccgaggccgacggcccgtggtggtcggtcgtcgttangatcgcggacccgcctacgacgggtactcccgtagacgtcgtacttcccgtcgtcggtccctacccgaaacgttcgggacggggaacccacccgggaccctacccgtacgaacccagtaccgacggtacggaacgggggtacggaaacgggggtccggggtaagtacgggaacgggtacccgtaaactttacgttaaccgttcggtacggtaggggttacgggtagggggggttaattaaggggtgggtagggtagtaactcgtaaccgttaccgtaacgttaccggttacggttaccggaacggtaacgggaaccgttacggtcccttaccgtccgtaacgccgacgcccgaaacggcccaaccgttcacttccgtccttcgttccccg

SEQ ID NO: 433012 - DNA, 614 bp, Homo sapiens
  misc_feature: GZ8MTXP01EVF5L.4.57.F02.1.454.CMB.2.raw
  modified_base (304)..(304): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataacctgtgtggaaccagcagtcggaaggtaaaagtgtacagttggtacaggacagaagccgaggccacggcccctggtggtggtcgtcgttangatgccgaccggcctcgagggctcccgtgacgcgtattcctcgtcggcctaccaacgtcgtacgggaaccaccgggcccacccgtcgaccctatcgagcgagggtcggaacgggccggggatcggacggccgtacgttatacgtgtcgagggtggtagggggataggtgtggtgatcgactccgtagttaccgtcgttaccgggacgtaacggggaacccttagggttcccgttacccgtccgtaacgttccgaccggaccccgaacggccctaaaccgtcccaacgttcgtcccttaaccgtttccccg

SEQ ID NO: 433013 - DNA, 684 bp, Homo sapiens
  misc_feature: GZ8MTXP01BSKX4.4.57.F02.1.454.CMB.2.raw
  modified_base (300)..(300): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcaggacggccaggataaccgtgtgtggaaccagcagtacgggaaggtaaaagtgtaacagttggtacaggcagaagccaggccaggccctggcggtggtcgtcgtangatagcgaccggcctcgagggactcccgtgagcgtattctcgtcggcctacaacgtcgtagggaaaccaccgggcccaccctgacccatcgagcgagggtacgaagggccggggatggacggccgtaacgtagttaccgtggtacgagggttggtaggggtaagttagggggttaggttggggtagtacgttaccgaacttcccgtaagttaccggttccgtttaaccgggggaaacgttcgggggaaacccgtaaacggggttccccttcccggttacccgttaccgggttacccaaccggttacccccgaaacgggttacccccaaaccccgtacgtccggtaccctacccgtttcccttcccggtttccccctaacccccg

SEQ ID NO: 433014 - DNA, 595 bp, Homo sapiens
  misc_feature: GZ8MTXP01AS0A9.4.57.F02.1.454.CMB.2.raw
  modified_base (340)..(340): a, c, t, g, unknown or other
  modified_base (342)..(342): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagcttgggttttcctcgttgctcttttaagaggtgtccagtgtcaggtgcaccgtggtggaggtcgggggagcgtggtccagccgtgggggtcctgagctctcctgtgcagcgtctggattcgccttcagtgcctagtggcagtgcacgtcgggtcccgcaggcctcgaggcgaggggctaggagtgggngntagttatagtggttgaagtgaaactaaaacaattcatgacagaccgtcggagaacgggccgtacttcaccatcctacaagtacgaactaacgttacgaacgtaacactagtaggtaatactaacgataagtacgaacgtagtacgtagaaggacggaccggaacgggaactacggttcgttagttcgttaagttagttgttggttaggtaagtaggttaaggtcggtcgttagttcggtttccgtttaacggg

SEQ ID NO: 433015 - DNA, 553 bp, Homo sapiens
  misc_feature: GZ8MTXP01EVS41.4.57.F02.1.454.CMB.2.raw
  modified_base (215)..(215): a, c, t, g, unknown or other
  modified_base (220)..(220): a, c, t, g, unknown or other
  modified_base (275)..(275): a, c, t, g, unknown or other
  modified_base (335)..(335): a, c, t, g, unknown or other
  modified_base (457)..(457): a, c, t, g, unknown or other
  modified_base (514)..(514): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagcgcagatactgtgnggacngcatcggaaggtaaagtgtacattggtacaggcaagagccaggccaggcccctgnggtggtcgtccgttatgataggcgacccggcctcgagggactcccgtgacgcgattcccncgtggctccaactccgtagggaaccacgggacccacccgtgaacccatcagcgagggtcgaagggccggggatggacggccgatatactggtcagggtgtaggggggattaggtagtgggtnatcgatccataccggtcttacggaactgggaaccaagggtccttcgtcctacgttcncgacccaaggccctaacgtccagttctcttcgtttcccg

SEQ ID NO: 433016 - DNA, 680 bp, Homo sapiens
  misc_feature: GZ8MTXP01BCAS3.4.57.F02.1.454.CMB.2.raw
  modified_base (224)..(224): a, c, t, g, unknown or other
  modified_base (299)..(299): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgccaccctcagtgtcaggtcggccccaggcagacggcagatactgtgtaggaacngcagtacggaagtaaagtgtacagttggacaggcaagacgcgaggccgacggcccctggtggtgtcgtacgttangatacggccgaccggcctacgacggtactcccgagacgtcgtacttcccgtcgtcggacctacccgaacgtcgtaacgggaaccacccgggcccctaacccgtcgaacccagtaccgacgggaccggtaacgggggtaccggaaacggggccggggtaagtacgggaaccggtacccgtaattacgttacgtcggttacgagggttgggtagggggtaagtaagggttaggtggtagtacgtactacgtaccgtagttaccgggttacttacggggaacttaacgggggaacttacggggtccccttaccggtacccttacggccgacggaccccgaaggacccctaactcccgacgttccgtaaccgttaacctttcccg

SEQ ID NO: 433017 - DNA, 556 bp, Homo sapiens
  misc_feature: GZ8MTXP01DN5R4.4.57.F02.1.454.CMB.2.raw
  modified_base (549)..(549): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcaggacggccaggataacctgtgtgggaaccagcagtcggaaggtaaaagtgtacattggtacaggcagaagccaggccaggcccctgtggtggtcgtccgttatgatagcgaccggccctcgaggggactcccgtgacgcgattccctctggcctacccaactccgtagggaaccacgggcccaccctgaccatcagcgagggtcggaagccggggatggacggccgactatactgtacgaggtggtagggggattaggtgtggtagatcgatcagtcgtcttacggaactgggacaaggtccttccgtcctacgttccgcgacccgaaggcccaaccgtcacttcgtccncttcccg

SEQ ID NO: 433018 - DNA, 585 bp, Homo sapiens
  misc_feature: GZ8MTXP01D48HO.4.57.F02.1.454.CMB.2.raw
  modified_base (256)..(256): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttnatggaactaacaaattctatgcagactccgtagaagggccattcaccatctcagagacaatttcgagaacacattgaatctaacagatagaaacagtctgaagagccgaggacacggctgtactattattgtgcgagagtaagtgtactatggtctttgacaggtcgggccgagggggtaaccctggtccaccgtctccgtcacgcttacccaccgtaaacgggcccctaacgtcccggttcccttcccccgtcgggcccgtccccgttgcccgttcccgacggaacgtccgaacccgttccggtcgggggcctaacgcggtccccggg

SEQ ID NO: 433019 - DNA, 664 bp, Homo sapiens
  misc_feature: GZ8MTXP01EF337.4.57.F02.1.454.CMB.2.raw
  modified_base (215)..(215): a, c, t, g, unknown or other
  modified_base (222)..(222): a, c, t, g, unknown or other
  modified_base (295)..(295): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggatactgtgnggaaccngcagtacgggaaggtaaagtgtacagttggtacaggcagaagccaggccaggccctggtggtggtcgtcgtangatagcgaccggcctcgagggactcccgtggagcgtattctcgtcggcctaccaacgtcgtacggggaaaacccaccgggcccaccctcgacccataccgaggcgaggggtacgaagggccggggtagtcgggacggacccgtaacgttaagttacgtcggtacgaggggttggtaggggtaagttagggggttaggttaggggtagtaacgttacgacgttacctaagttaccggttcgttaccggggaaacgttcggggaaccctaacgggttccttacccggtaccttaccgtacgaaccgaccccgaaacggacccctaaccccgacgtcgtacctaccgttccttcccgttccccgtaaccccc

SEQ ID NO: 433020 - DNA, 643 bp, Homo sapiens
  misc_feature: GZ8MTXP01DAQXO.4.57.F02.1.454.CMB.2.raw
  modified_base (206)..(206): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccncaggctccaggcaaggggctggaatgggtgctagttatatggtttgataggaaactaacaaattctatgcagactccgtgaaggccgattcacatctccagagactaatttcgaagaacactattgaaatctaacagtatacgaacagtctagagaacgccgaaggacacgggctgtctattatgtgcgagtagtagtggtcagttcggttctttagaccgtaggtcggggaccgtaacggggaacccgttcgggttaccaccggttcctccctccgacgtccttacccgaaccgtaacgggtcccctacgttcccgggttcccttcccccggttgggtccccgttccccgttcggcccgttacccgacgggttaccggccctacccggttcgggtaccggggggaccttaacccgggccggcccggggtccccggg

SEQ ID NO: 433021 - DNA, 681 bp, Homo sapiens
  misc_feature: GZ8MTXP01DDS65.4.57.F02.1.454.CMB.2.raw
  modified_base (179)..(179): a, c, t, g, unknown or other
  modified_base (217)..(217): a, c, t, g, unknown or other
  modified_base (227)..(227): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctnagtgtcaggtcggcccgaggcagacgcaggactactgngtaggaaccngcagtcgggaaaggtaaagtgtacagttggacgaggacagaacgccgacggccacggcccctggtgggtcggtccgtccgttatgacgtacggccgaccccggcctacgacggggactccgtagacgcgtacttccgtcgtcggcctaccaacgtcgtacgggaaccgacccgcccacccgtcgacctacgtacgacggacgaggggtaccggaacggggccggggagtacgggaacgggaccgtaacttaacgttacgtcgtacggtaggggtacggtaggggggtaagttaggggttaagggtggtagtatctacgtaccgtacgtacggttccgtaacgggtaacggtcggggaaacccgttacgggttcccttcccggttaccgtacgttaccgacccgacccgaacggaccctaacctcccgtacttccggtccttaaccgttccccgg

SEQ ID NO: 433022 - DNA, 623 bp, Homo sapiens
  misc_feature: GZ8MTXP01EW31O.4.57.F02.1.454.CMB.2.raw
  modified_base (212)..(212): a, c, t, g, unknown or other
  modified_base (217)..(217): a, c, t, g, unknown or other
  modified_base (292)..(292): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggcaggatactgtgnggacngcatcgggaaggtaaagtgtacagttggacaggcagaacgccgaggccacggccctggtggtcggtcgtcgttangatacgccgaccggcctcgagggactcccgtggacgcgtattctcgtcggcctaccaacgtcgacgggaaaaccaccggcccaaccctgacccagtccgagcgaggggtaccgaacgggccggggatcggacggcccgtaatacgttacgtgtcgagggtggtagggaattaggggtaggtggtagactctatcccgtaagtaccggttcgttacgggaacgtcgggaacccgtaaggttcccttcccgtaccttacggaccgaaccgaccccgaacggcccctaaaccccgctcggtcccacttcccgttcccgttaaccccctaacccc

SEQ ID NO: 433023 - DNA, 625 bp, Homo sapiens
  misc_feature: GZ8MTXP01DZ6WN.4.57.F02.1.454.CMB.2.raw
  modified_base (213)..(213): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacgcaggataactgtgnggaacagcagtcggaagtaaagtgtacagttggacaggcagagcaggccacggccctggtggtggtcgtcgtatgatacgcgacccggcctcgacgggctcccgtgagcgtattctcgtcggcctacaacgtcgtacgggaaacccaccggcccacccgtcgacccatcgacggcgaacgggtacgaacgggcggggagtggacggtaccgtaacgttagttacgtgtcgagggtggtagggtattaggggttaggtggtagagtacagtccaagttaccgttcgttaaccgggaacgttcggggaaccctaaagggttccttcccggttaccgttacggtaccgaacggaccccgaacggacccctaaccccagttccgtaccaccgttcctcccgtttccccctaacccc

SEQ ID NO: 433024 - DNA, 652 bp, Homo sapiens
  misc_feature: GZ8MTXP01C11I7.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtggaaccagcatcgggaaggtaaaagtgtacattggacaggcagaagccaggccaggcccctggtggtggtcgtcgtatgatagcgaccggcctgagggactccctgacgcgtattcctctggctaccaactcgtacgggaaccaccgggcccacccgtcgaacccagtccgagcgtagggtacggaaacgggccggggatacgggaacgggtaccgtaacttaacgttaccgtgtacggtagggtgggtagggggtagttaggggtaggtgggtagtacgtactacgtacccgtaagttacccggttacgtaccgggtaaacgttaacggggaacccgttaacgggttcccttccccggttaccgtaaccggttccgacggaccccgaacggtaccctaacctcccgtaacgttcgtcccttaaccgttcccgg

SEQ ID NO: 433025 - DNA, 670 bp, Homo sapiens
  misc_feature: GZ8MTXP01DMDMA.4.57.F02.1.454.CMB.2.raw
  modified_base (208)..(208): a, c, t, g, unknown or other
  modified_base (541)..(541): a, c, t, g, unknown or other
  modified_base (594)..(594): a, c, t, g, unknown or other
tcagagcactgtagcacgaccggtgctcgatttagctcgatataggttgggtttggggggaagaggaagactgacggtcctcccaggagttcaggtgctgggcaccgtgggcatgggggaggcgtggtccagccgtggggggtccctgagactctcctgtgcagcgtctggattcgccttcagtgcctatggcatgcacgtgggtccnccaggctccaggcaaggggctggaatgggtgctagttatagtggttgataggaaactaacaaattctatgacagactccgtgaacggccgtattccaccatcctccgaagacgaactttaagtacggaactaacaacgtttagtaacgtaacttactaagatagtaacgaacgtagtcgaagaacggaacgacggaacgacgtcgtacttcgttacttaattgttagcgaagtaaggtaaggtacggttgtaagttacggtttcgtttacgttcggacgtaggggtacggaaccgtaaccgggtaccggttacgtaccgtaccgtcctaccgntaccgttccctaacgaacggtcccgtctacgttcccgtaacccctttcccggnggccccttcgtcgtacccacggttaacgcccggaacctcgggtcgggccgggcttacgggccgttcccggtaacgg

SEQ ID NO: 433026 - DNA, 669 bp, Homo sapiens
  misc_feature: GZ8MTXP01BV1A7.4.57.F02.1.454.CMB.2.raw
  modified_base (224)..(224): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccaggcagacgcagataacctgtgtggaaccngcagtacggaaggtaaaagtgtacagttggtacaggacaagaacgccgaggccacggcccctggtggtggtcgtccgttatgatacgcgacccggcctcgagggactcccgtgacgcgtacttccctcgtcggcctacccaacgttacgtacgggaaccgacccgggcccctaaccccgtcgaaccctagtccgaacggccggaaggggtaccggaaacggggcccgggggaatcgggaaccgggaccgtaacgttaacgttaaccgtggtacgtaagggttgggttagggggtaagttagggttaggtagggttacacgtactacgtacccgtagttaccggtcgttaaccgggaacgtaacgggaaccgttaacgggtcccttccggtaccgttacgcgacgcccgaacggccaacctccacttcgtaaccttccgtttcccg

SEQ ID NO: 433027 - DNA, 598 bp, Homo sapiens
  misc_feature: GZ8MTXP01A2H5V.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggatacctgtgtaggaaccagcagtcgggaaggtaaaatgtacagttggtacaggcagaagccttaggccacggcccctggtggtggtcgtccgtatgatagcgaccggccctcgacgggactcccgtgagcgtattctctcggctaccaactcgtcgggaaaccaccgggccaccctgacccatcgacgacgacgggtacgaacggcggggatcggacggccgtactagttaactggtacgaggtggtagggtagtaggggtagtggtgatcgactcagtacgtcgtcggacgtcgggaaccgtaacggtcttcccgtccttaccgtcgaccggacccgaacgggacccaacccctacgtccgtctaccgttcctaaccgttcccctaacccc

SEQ ID NO: 433028 - DNA, 440 bp, Homo sapiens
  misc_feature: GZ8MTXP01DHNT7.4.57.F02.1.454.CMB.2.raw
  modified_base (323)..(323): a, c, t, g, unknown or other
  modified_base (348)..(348): a, c, t, g, unknown or other
  modified_base (408)..(408): a, c, t, g, unknown or other
  modified_base (417)..(417): a, c, t, g, unknown or other
  modified_base (430)..(440): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggagtaaaagtgtacatggtacaggcagaaagccaggccaggcccctgtggtggtcgtccgtatgatagcgaccggccctcagggatccctnagcgattcctctggctccaaactcngggaacacggcaaccctgaccaatcagcagggtcgaaagccggggatgaggccatattangtgaggtgnggggatagtagtnnnnnnnnnnn

SEQ ID NO: 433029 - DNA, 549 bp, Homo sapiens
  misc_feature: GZ8MTXP01BW9GK.4.57.F02.1.454.CMB.2.raw
  modified_base (406)..(406): a, c, t, g, unknown or other
  modified_base (450)..(450): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggagtaaagtgtacattggtacaggcagaagccaggccaggcccctgtggtggtcgtcgtatgatagcgaccggcctcagggatccctgacgcgattctctcggctccgaatctgggaaaacacggccaccctgacccatcagcagggtcgaagccggggatgaggcgactatactgacnggtgaggataggggagttggtgattcaacgtccagttaaccgtnttacggaactggggaccaagggttccttccgtccttaacgtcgacgttccccgaaggccccaaccccactcggtaccaccgttcttcgttccccgtccc

SEQ ID NO: 433030 - DNA, 594 bp, Homo sapiens
  misc_feature: GZ8MTXP01DE7C5.4.57.F02.1.454.CMB.2.raw
  modified_base (257)..(257): a, c, t, g, unknown or other
  modified_base (305)..(305): a, c, t, g, unknown or other
  modified_base (393)..(393): a, c, t, g, unknown or other
  modified_base (555)..(555): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgtagcgtctggattcgccttcagtgcctatggcatgcactgggtccgccaggcctccaggcaaaggggctggaatggggtgcagttatatggttnatggaaactaacaaattcatgcagactccgtgaaggccattcacatcncagagactaattcgaagaacatattagaattctaacagatcgaaacagtctagaagaagccgaaggacacgggctagtctaattatgngcgagagtaagtgtacagttgttctttgaccgaggtcgggacgaacgggaaccgtggtaccaccgtcctccgtcacgtccttacccaaccgaacgggccctacgttcccggtcccttcccccgttcgggcccgccccgttacggcccttccgacgggacccnccgaccgtcgggtcggggaccacggtccggcccggtccg

SEQ ID NO: 433031 - DNA, 692 bp, Homo sapiens
  misc_feature: GZ8MTXP01BRZ43.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcacgtgggtccgccaggcctccaggcgaaggggctggaatggggtgctagttatagtggtttgataggaaactaacaaattctatgcagactccggtgaacgggcctatcaccatctccagagactaattcgagaacactattgaattctaacagatacgaacagtctagagacgaccggaaggacacgggtctgttactattagttgtagacgtagtagtaagtggtactagttcggttctttacgacgtacggtcggggaccgtaaccggggtaacccgttcggtaccgtacccgttcctcccgtaccgtacgtcccttacccgaacccgtaaccggggtcccctaacggttccccggttccctttccccccggttcgggtccccgttccccgttccggtacccgttcccggacgggttaccggtaaccccgtacccgggttccgggtaccggggggtacccacccgggtaaccgggttccccgggtccccgggg

SEQ ID NO: 433032 - DNA, 609 bp, Homo sapiens
  misc_feature: GZ8MTXP01DH9NO.4.57.F02.1.454.CMB.2.raw
  modified_base (300)..(300): a, c, t, g, unknown or other
  modified_base (334)..(334): a, c, t, g, unknown or other
  modified_base (376)..(376): a, c, t, g, unknown or other
  modified_base (441)..(441): a, c, t, g, unknown or other
  modified_base (477)..(477): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcacgccaccctcagtgtcaggtcggcccagggcagacggcaggataacgtgtgtaggaacagcagtacggaagtaaagtgtacagttggacaggacagaacgccaggccgacggccctggtggtcggtcgtcgttancggataggccgacccggcctagagggactcccgngacgcgtattcgtcgtcggcctacaacgtcgtacggaaaccncgcccacctgaccatcgagcgaggggtcgaacggccggggatcgggacggtcaagttacttacgngtcgagggtggtagggtattaggggtggttcgggtnactactagtcctacgtaccggttcgtacggtaacgtccgggaacttaacggtcccgttccgttaccggttcacccgaacgaccccgaaacggccccaaccctgtcgtccaccttctcccgttcccctaaccc

SEQ ID NO: 433033 - DNA, 569 bp, Homo sapiens
  misc_feature: GZ8MTXP01ABZEL.4.57.F02.1.454.CMB.2.raw
  modified_base (472)..(472): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtcggccccaggggcagacggccaggataaccgtgtgtgggaaccagcatcggaaggtaaaagtgtacattggtacaggcagaagccaggcctaggcccctggtggtaggtctccgttatgatagcgaccggcctcagggactccctgagcgatctctcggctcaactcgtacgggaaacacggtccgaccctacggacactcacgcgacgggacgaacgaccggggatggacggaccggacctattaacgtggtacagggtagtgggagtaggggtagtagggtcagtcaancatacgtctcggaacgtggaccgaaggtcttcggtccgttacgtcgacgacccgacggacccaacccctactcgtctcttcctccgttccccgtccg

SEQ ID NO: 433034 - DNA, 624 bp, Homo sapiens
  misc_feature: GZ8MTXP01CNXQI.4.57.F02.1.454.CMB.2.raw
  modified_base (222)..(222): a, c, t, g, unknown or other
  modified_base (496)..(496): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccaggcagacggcaggataactgtgtggaaccancgggatcggaaggtaaaagtgtacattggtacaggcagaagccaggccaggccctgtggtggtcgtcgtatgatagcgaccgcctgaggctccctgagcgtattctctcggcctccgaactcgtacggggaaaaccaccgggcccaccccgtacgaacccatccgaacgtcgaacggggtaccggaaacgggcccgggggaatcggggaacggcccgtaacttacgttacgtcggtacgtagggtggtaggggtaattaggggttaggtgggtnagtcagtccgtaagtaccgtcgttaccgggaacgtcggggaaccaagggtccttaccgtccttacgtaccgacgaccccgaacggccccaaaccctcgtcgtcctacttcctccgttcccctaacccc

SEQ ID NO: 433035 - DNA, 628 bp, Homo sapiens
  misc_feature: GZ8MTXP01AUCEN.4.57.F02.1.454.CMB.2.raw
  modified_base (229)..(229): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctcagtgtcagtcggccccagggcagacggcaggactaacctgtgtagggaaccngcagtcgggaaggtaaaagtgtacagttggacaggcagaagccaggccaggcccctggtggtggtcgtcgttatgatagccgaccggccctcgagggactccgtgagcgtattccctctggcctccaactcgtacgggaaccacgggcccaccctcgaccatcgacgcgacgggtacgaacgggtccggggatggaacgggccgtaacgttacgttacgtcgtacgagggttcggtagggggaagttaggtaggtgggtagtatcgtacgtaccgtagttccggttaccgttacgggaaccggtcgggtaaccgttaacgggttcccttcccggtacccgtacggttacgaccgacccgtaacggaccctaaccgtccacgttctccgaactttccccg

SEQ ID NO: 433036 - DNA, 605 bp, Homo sapiens
  misc_feature: GZ8MTXP01EDUCA.4.57.F02.1.454.CMB.2.raw
  modified_base (230)..(230): a, c, t, g, unknown or other
  modified_base (345)..(345): a, c, t, g, unknown or other
  modified_base (431)..(431): a, c, t, g, unknown or other
  modified_base (595)..(595): a, c, t, g, unknown or other
tcagagcactgtagcacgaccggtgctcgatttagctcgatatagttgggtttggggctgggcctaaggaagcagcactgggtggtgcctcagccatggcctggaccgttctcctcctcggcctcctctctcactgcacaggctctgtgacctcatatgtgctgactcagccaccctcagtgtcagtcggccccagggcagacggccaggataacctgtgtagggaaccngcagtcgggaaggtaaaagtgtacattggtacaggcagaagccaggccaggcccctggtggtggtcgtccgtatgatagcgaccggcctcgagggactccctgacgcgtattccnctggctccaactcgtagggaacacggccaccctgaccatcagcgagggtcgaaggccgggatcggaacggccgtacttagttacgngtacgagggttggtagggggtattagggttaggtgggttagaacttcgacttacccgtaagttaccgtacgtttaacggaaaccgtcggggaacccttaagggtcccttcccgtaccgtaacgttcgacgacccgaacggccctaactcccacgttcgtaaccncgttaacccg

SEQ ID NO: 433037 - DNA, 706 bp, Homo sapiens
  misc_feature: GZ8MTXP01A276R.4.57.F02.1.454.CMB.2.raw
  modified_base (305)..(305): a, c, t, g, unknown or other
  modified_base (346)..(346): a, c, t, g, unknown or other
  modified_base (376)..(376): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtcggcccagggcaggacggccaggactaaccgtgtggtagggaaccagcagtacgggaaggtaaaagtgtaacagttggtacaggcaagaacgccgaggccaggccctggtggtggtcgtcgtangataggccgaccggcctgagggactcccgtgacgcgattcncgtcggcctacgaactcgtagggaaaaccncccgggcccacccgtgaccatcgacggcgagggtacgaaggccggggatcgggacggccgtaacttacgttacgcggtcgagggttggtaggggtaattagggggtacgggttaggtagtacgtactcgtaccctaagtttacccggttacgttaccggggtaaaccgttcggggaaacccgtaacgggtttccccgttcccggttaacccgttacgggtacccgaacccgggaacccccgttaaacgggttacccccccaaaccccgggtactttaacccggtaccctacccgtttccccggtttaacccgttccccccctaacccccg

SEQ ID NO: 433038 - DNA, 662 bp, Homo sapiens
  misc_feature: GZ8MTXP01BHDWF.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaaactaacaaattctatgcagactccgtgaagggccgattcacatctccagagacaatttcgaagacacattgaatctacagatcgaacagtctgagaagccgaagacacggctgtctattattgtgcgagtagtaagtggtatagttcggttccttttgaccgtaggtcggggaccgaaggggtaaacccggtttggggtccgtaacccggttcctcccttaccgacggtacctttaccccgaaacccgtaaacgggggtacccctaacgttcccgggttccccgtttccccccgttcgggtccccgttccccgttccggcccgttacccgcgggaaccgtcccggtaaccccgttccgggttccggggggcccaaaccggtccgggttccccggggtcccccgggg

SEQ ID NO: 433039 - DNA, 642 bp, Homo sapiens
  misc_feature: GZ8MTXP01AIYHW.4.57.F02.1.454.CMB.2.raw
  modified_base (619)..(619): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtacagttggtacaggcagagccaggccaggcccctgtggtggtcgtccgtatgatagcgaccggcctcgagggactcccgtgacgcgtattctcgtcggcctacaacgtcgtacgggaaaaccaccgggcccacccgtcggaaccctacgtccgacggcgaacgggggttcggaaacgggcccggggggagtacgggacggggacccgtaacgttaacgtttaccgtaggtcgaaggggttgggtaggggtaagtagggggttaaggtggggttcggaattctacgtacctaagtaccggttcttacgggaaccgtcggggaacctaacgggtccttcccggtaccttacgtcacgcccgacggccccaacccntcgcacttctccgttccctcccc

SEQ ID NO: 433040 - DNA, 569 bp, Homo sapiens
  misc_feature: GZ8MTXP01A5IGS.4.57.F02.1.454.CMB.2.raw
  modified_base (336)..(336): a, c, t, g, unknown or other
  modified_base (544)..(544): a, c, t, g, unknown or other
  modified_base (546)..(546): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggacggccaggataacctgtgtggaaccagcatcgggaaggtaaaagtgtacattggtacaggcagaagccaggccagcccctgtggtggtcgtcgttatgatagcgaccggccctcgaggggactcccgtgagcgattcnctggcctaccaactcgtgggaaaccaccgggccaccctgacccatccagcgaaggggtcgaaagggcccggggatcggacgggcccgaacttattaccgtgtcgaaggtggtagggataggggtagtggtagatcgactccgatacgtcttcggaactcggggactaaggtcttccgtcccttagtccacgcccgaggcccaaacccncncgtcacttctccgttccaacccc

SEQ ID NO: 433041 - DNA, 578 bp, Homo sapiens
  misc_feature: GZ8MTXP01EDJPQ.4.57.F02.1.454.CMB.2.raw
  modified_base (334)..(334): a, c, t, g, unknown or other
  modified_base (360)..(360): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacgcaggataactgtgtggacagcagtcggaaggtaaaagtgtacattggacaggcagaagccaggccaggcccctggtggtggtcgtccgttatgatagcgaccggccctcgagggactccctgagcgattccncgtggcctccaactcgtacgggaacncggcccaccctgaccatcagcgagggtcgaaggccgggatggacggccgtactagttacgtgtcgagggtggtagggggtattaagggtaggtgggtagacttctaagtacccagttaccggttcttacgggaacgtcgggaaccttaagggtcccttccgtacctacggttccgacgcccgaaggcccaacgtcccacttcgtccttaacgttcccg

SEQ ID NO: 433042 - DNA, 581 bp, Homo sapiens
  misc_feature: GZ8MTXP01DL3IE.4.57.F02.1.454.CMB.2.raw
  modified_base (173)..(173): a, c, t, g, unknown or other
  modified_base (222)..(222): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctnagtgtcagtggccccagggcagacggccaggataactgtgtgggaaccngcagtcgggaaggtaaaagtgtacattggtacaggcagaagcaggccaggccctgtggtggtgtccgtatgatagccgaccggccctcgagggactccctgagcgtattctcgtacggcctaccaacgtcgtagggaaaaccacgggcccaccctgacccatcagcgaggggtacgaaggccggggatggagggccgaactagttactggtcaagggtgtagggataggggtaagtgggtagatcagtccagtacgtcgttacggaacgtcgggaacctaaggtccttccgtccacggtcacggacccgttaaggcccctaaaccccatcgtctaccttccgttcccaacccgttcccc

SEQ ID NO: 433043 - DNA, 581 bp, Homo sapiens
  misc_feature: GZ8MTXP01EW7B1.4.57.F02.1.454.CMB.2.raw
  modified_base (301)..(301): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggccaggataacctgtgtggaaccagcatcggaaggtaaaagtgtacattggtacaggcagaagccaggccaggcccctgtggtggtcgtccgttangatagcgaccggccctcgagggtactccctgagcgattccctctggcctccaactctggggaaccaccgggcccaccctgacccatcagcacggggtcgaaggcccgggggatggaacgggcccgtaacgttaattacgtgtccgaaggggtggtaggggggattaaggtagtggtagatcatccataccgtcttacggaactgggaccttaaggtccttcccgtctacgttcacgccccaacggccccaaacccgctcgcctaaccgttcttaaccccg

SEQ ID NO: 433044 - DNA, 612 bp, Homo sapiens
  misc_feature: GZ8MTXP01D2EPY.4.57.F02.1.454.CMB.2.raw
  modified_base (153)..(153): a, c, t, g, unknown or other
  modified_base (306)..(306): a, c, t, g, unknown or other
  modified_base (355)..(355): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcagcccaccctcagtgtcagtcggccccagggcaggacggcaggataactgtgtaggaaccagcagtacgggaaggtaaagtgtacagttggtacaggcaagaacgccgaggccacggcccctggtggtggtcgtcgtangagtacgcgaccggccctacgaggactcccgtagacgtcgtacttcccncgtggcctaccaacgtccgtagggaaccgaccgggcccacccgtcgaccatcgagacgagggtacgaacggcggggatgggacggccgtacttagttacgtggtacgagggtggtagggggtattaggtgtaggtgatcagtaccgagttaccgtcgttacggaacggtcgggaaccacgggttccttccggtaccgtacgttaccgaccgacccgaacgtaccctaactcccacgttcgtaacccttcgtttcccg

SEQ ID NO: 433045 - DNA, 680 bp, Homo sapiens
  misc_feature: GZ8MTXP01EZI1N.4.57.F02.1.454.CMB.2.raw
  modified_base (300)..(300): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccaggggcagacggccaggataacctgtgtgggaaccagcatcgggaaggtaaaagtgtacattggtacaggcagaagccaggccaggccctggtggtggtcgtccgttangatacgcgacccggcctcgagggactcccgtgacgcgtattctcgtcggacctaccgaaacgtcgtacggggaaacccacccgggcccaccctacggacccacgtcgaggccgacggggtacgaacgggtcccggggagtacgggacgggaccgtaacgttacgtttaccgtggtacgaggggttggttaggggagttaagggggtagggttggtaggtactacacgtcctaagttaccggttcgttacgggaacgtcggggaacccgtaacgggtccttacccggtaccgttaccggtcccgaaccggaccccgttaaacggccccctaaaccccgtcttcggtccctaccgttccgttcccggtttccccccgtcccc

SEQ ID NO: 433046 - DNA, 601 bp, Homo sapiens
  misc_feature: GZ8MTXP01CYUWU.4.57.F02.1.454.CMB.2.raw
  modified_base (306)..(306): a, c, t, g, unknown or other
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccgccaggctccaggcgaagggggctggaatggggtggcagttatatggtttgatggaaactaacaaattcatgcagactccgtagaaggccatcacatcnccaagagaactaattcgaagaacacaatttgaaattctaaacagaatacgaaacagtctagaagaacgcggaaggacacgggcttgtctaatttactgtgacgaagaagtaaggtgtcagtggttctttgaccgtggtcgggcgaacgggacccgtggtaccaccgtctcctcgacgtccttacccgaccgtacggggcccctacgtcccggttcctcccccgttcggccgcccgtcgccttaccgcggacgaaccgcccgtccggtcgggggccaccgaacggccgggtcccgg

SEQ ID NO: 433047 - DNA, 672 bp, Homo sapiens
  misc_feature: GZ8MTXP01EMCWG.4.57.F02.1.454.CMB.2.raw
  modified_base (291)..(291): a, c, t, g, unknown or other
  modified_base (356)..(356): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacgccaggataactgtgtggaaccagcatcgggaaggtaaaagtgtacattggtacaggcagaagccaggccaggcccctgtggtggtcgtcgttangatagcgaccggccctcgagggactcccgtgagcgattctctcggctcaactcgtcgggaaaccncggcccaccctgacccatcagcgaggggtcgaaggccggggatcggaggccgtaacttaagttacctggtcgtagggtggttagggagttaaggggtaggttaggggtgtaatccaagttccctaagttaccggtccgtttaccggggaaaccgttacgggggaacccctaaaggggttcccttacccggttccccgttaaaccggtcccgaaacggaccccccggaaacgggacccccctaaaaccccccgtaacgttcccggttacccaaccccttcccgttaaccccggttttaaccccccctaacccccccg

SEQ ID NO: 433048 - DNA, 536 bp, Homo sapiens
  misc_feature: GZ8MTXP01DQ3SL.4.57.F02.1.454.CMB.2.raw
  modified_base (490)..(490): a, c, t, g, unknown or other
  modified_base (517)..(517): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggcaggataacctgtgtggaaccagcatcgggaaggtaaaagtgtacattggtacaggcagaagccagccaggccctgtggtggtcgtcgtatgatagcgaccggccctcgagggactccctgagcgattctctggctcaactctggaaacacggccaccctgacccatcagcagggtcgaaggccggggatggacggccgaactattacgtgtcgagggtgtagggattaggggtagtggtgatcaatcagtacgtcttcggaactgggaccaagtcttccgtcttacgtcncgacccacggacccaacccactcgtcncttctcgttccccgtcccc

SEQ ID NO: 433049 - DNA, 625 bp, Homo sapiens
  misc_feature: GZ8MTXP01DI0EX.4.57.F02.1.454.CMB.2.raw
  modified_base (355)..(355): a, c, t, g, unknown or other
  modified_base (365)..(365): a, c, t, g, unknown or other
tcagagcactgtagcacgaccggtgctcgatttagctcgatatagttgggtttggggggaagaggaagactgacggtcctcccaggtgtccagtgtcaggtgcacctggtggaggtcggggggaggcgtggtccaggcccgtggggggtccctgagactctcctgtgcagcgtctggattcgccttcagtgcctatggcatgcacgtggggtcccgccaggcctccgagggcgaagggggctgggaatggggtgcagttatagtggtttgataggaaactaaacaaattctaatgcagactcgtagaaggccatcacatctcagagactaattcgaagaacacattagaatctanagatagaacngtcagaagacgccgaggacgcggctgtactatatgtgacgagagtaagtgtactagttggttctttagaccgtagggtcggggaccgaacgggggtaacccgtggtaccgtaccggttcctacccgtcacgtaccttacccgaaccgtaacgggcccctacgttcccggttcccttccccgtcggcccgtcccgtcgcccgttccgaacggtaaccgtcccgtaaccgttcgggcgggggacctaacggcggtccccggg

SEQ ID NO: 433050 - DNA, 692 bp, Homo sapiens
  misc_feature: GZ8MTXP01ASRFV.4.57.F02.1.454.CMB.2.raw
  modified_base (180)..(180): a, c, t, g, unknown or other
  modified_base (245)..(245): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagccgtggggggtccctgagactctcctgtgcagcgtctggattcgccttnagtgcctatggcatgcactgggtccgccaggcctaccgaggcgaaggggcgtggaagtgggtggngtagttagtagttggttagtagtagtaaactaactaattatatgacgacgtacgtacggtacggaacggtacgtactactacctactactacacgaacgtaactaacttaacgaacgaactaactaattagtaataactaacagtacgtaacgaacgtagtacgtacgagaacgacggaacggtacgtacggtacgttacgttacgttacgttagttagtacggtaggtaaggtaaggtaaggttaggttacgttacgttacggttacgttacggtacggtacgggtacgggtaccggtaaccggtaccggggtacgtaccgtaccgtaccgtccgtccgtaccgtaccgtaccgtaccgtaccgtaccgtccgtcccgtcccgtcccgttccgtcccgttccgtccgtccgttcgccgccgtcgtcgtcggcggcgcgtcgcgtcg

SEQ ID NO: 433051 - DNA, 630 bp, Homo sapiens
  misc_feature: GZ8MTXP01BC8G5.4.57.F02.1.454.CMB.2.raw
  modified_base (211)..(211): a, c, t, g, unknown or other
  modified_base (366)..(366): a, c, t, g, unknown or other
  modified_base (590)..(590): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagccgtggggggtccctgagactctcctgtgcagcgtctggattcgccttcagtgcctatggcatgcacgtgggtccnccaggctccgaggcaagggggctgggaatggggtgctagttatatggtttgataggaaactaacaaattctatgacagactccggtagaacgggccattcacatctccagagactaatttcgaagaacactattagaatctaacagataggaacngtctagaagagccgagacacggtctgtctattatgtgacgagtagtagtgtactagttcggtctttagacgtaggtcggggccgacgggggtaacccgttgggtaccctaccgttctcccgttcgaccgtcccttaccgaacccgtaaaccgggtccccgtaacgttcccgggttccctttcccccggtcgggcccgtccccgtcgcccgttccggacggaacnccgtaacccgtcggtacgggggccaacgcgggtccccggg

SEQ ID NO: 433052 - DNA, 610 bp, Homo sapiens
  misc_feature: GZ8MTXP01BCJ77.4.57.F02.1.454.CMB.2.raw
  modified_base (173)..(173): a, c, t, g, unknown or other
  modified_base (208)..(208): a, c, t, g, unknown or other
  modified_base (210)..(210): a, c, t, g, unknown or other
  modified_base (215)..(215): a, c, t, g, unknown or other
  modified_base (217)..(217): a, c, t, g, unknown or other
  modified_base (275)..(275): a, c, t, g, unknown or other
  modified_base (342)..(342): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcagtcgcccaggcagacgcaggataactgngnggacngnatcggagtaaatgtacatggtacagcagagcaggcaggccctgtggtggtcgtcgtangatagcgaccggcctcgagggtactcccgtgagcgacttctctcggctccaactcgtggggaaaccnccggccacccgtgaccatccgagcgacgggtacgaacggccgggggatacggacggccgacttaagttcgtcggttcgagggtggtaggggataggggtaggtggtgaactcactccgaacgttacggtcgtttacgggaacgttcggggaacccgtaacgggttccttaccgggtacccttaccgggtacaacccggaccccgaaaccgggaccccaaaacccccgtctcggttacccacttcccgttccggttcccccgtcccccg

SEQ ID NO: 433053 - DNA, 753 bp, Homo sapiens
  misc_feature: GZ8MTXP01AEGBC.4.57.F02.1.454.CMB.2.raw
  modified_base (332)..(332): a, c, t, g, unknown or other
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtcgggtccgccaggcctaccgaggcgaaggggctaggaagtgggtgctagttatagttggtttagataggaaactaaactaattctatgacagactccggtaggaacgggcctattcacatcctaccaaganaactaagtttacgaagaacactatttagaaacttctaacagtactacgaaaccgtagttaccgtaggaacggaaacgggacccggaagggtaccgaacgggtctttaggttacttaagtttagttacgggtgtacggtaaggtaagggttaaaggttcgggtactaaggttcgggtttaccgttttcggaaccggtagggttcggggacccgtaacggggtaaccccgttggggtacccctaccggtcccttcccgtacgaccgtacccgttacccgaacccggtaccggggtaccccttacgggttccccggttccccttccccggttcgggtccccgttcccgtcggtacccgttcccgacgggacccgtccgtaccggttcgggacgggggccttaccggtcggccccgggtcccggg

SEQ ID NO: 433054 - DNA, 620 bp, Homo sapiens
  misc_feature: GZ8MTXP01AENNO.4.57.F02.1.454.CMB.2.raw
  modified_base (292)..(292): a, c, t, g, unknown or other
  modified_base (327)..(327): a, c, t, g, unknown or other
  modified_base (367)..(367): a, c, t, g, unknown or other
  modified_base (445)..(445): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacgcaggatactgtgtggaaccagcagtacgggaaggtaaaagtgtacagttggtacaggcagaagccaggccacggccctggtggtgtcgtcgttangataggcgaccggccctcgagggctcccgtggacncgtattctcgtcggcctaccgaactcgtacgggaaaaccnccgggcccacccgtacgaccactcgagcgaacggggtcgaaacggccggggatcggacggtccgaagttattaaccgngttacggaagggttggagggtagtaaggggtgtcgggttgaacttcgacttccagttaaccgtcgttacggaaacgtggggaccctaaggtccttccggacccttacgtacgacccgacccgttacgaccccaaccctaggtcctcccacttccttaaccgttcccctaaccccg

SEQ ID NO: 433055 - DNA, 620 bp, Homo sapiens
  misc_feature: GZ8MTXP01DC30X.4.57.F02.1.454.CMB.2.raw
  modified_base (216)..(216): a, c, t, g, unknown or other
  modified_base (298)..(298): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggccccagggcagacgcaggataactgtgnggaaccagcagtcggaaggtaaagtgtacagttggtacaggcagaagccgaggccaggcccctggtggtggtcgtccgttangatagcgaccggcctcgaggctcccgtgagcgtacttcccgcgtggcctaccaactcgtacggggaaccaccgggtcccaacccgtgaacccagtcaaggcgaggggtcggaaacgggcccggggatcgggaggacccgtattacgtacgtgtacgagggtgtaggggggattaggtagtgggtagatcgataccagttaccgttcgtacggtaacgtaacgggaaccttaagggttcccttaccggttccgtaaccggttacgaccggacccgaaacgggtacccctaaacttccccgaacgttcgtccaacgtttccccg

SEQ ID NO: 433056 - DNA, 662 bp, Homo sapiens
  misc_feature: GZ8MTXP01CLEA8.4.57.F02.1.454.CMB.2.raw
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagcccacctcagtgtcaggtcggccccagggcaggacggcaggataactgtgtggaaccagcagtacgggaaggtaaaagtgtaacagttggtacaggcagaagccaggccaggccctggtgggtggtcgtccgttatgatacgcgaccggcctcgagggactcccgtgagcgtattctcgtcggcctacaacgtcgtaggggaaacctacgggcccaccctagaccctatcgacggcgacggggtacgaacgggccggggatcgggacggacccgtacttagttaccgtgtaccgtagggtcgggtagggagttagggggttaggttgggtgaacgttcgacttaccgtacgttaacggtccgtttacggggaacttcggggaacccgtaaggttccgttacccggtcccgttaggtcccgaacggttaccccgaacgggacccccaaacccctacgtccgtaccctacttcccgttccggttcccccttaaccccg

SEQ ID NO: 433057 - DNA, 734 bp, Homo sapiens
  misc_feature: GZ8MTXP01AFO4A.4.57.F02.1.454.CMB.2.raw
  modified_base (175)..(175): a, c, t, g, unknown or other
  modified_base (311)..(311): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagcccaccctnagtgtcagtcggccccgagggcaggacggccaggactaacctgtgtaggaaccagcagtacgggaaggtaaaagtgtacagttaggacaggcaaggacgccgacggccgacggccctggtggtcggtcgtcgttangatacggccgaccggccctcggacgggactcccgtagacgtcgtacttcgtcgtcggcctacaacgtcgtacggggaaacccaccgggcccacccgtacgaccagtacgacggcgaagggggtaccgaacggggcccgggggtatacgggacgaccgtaacgttagttaccgtggtacggtagggtggtagggtagttaggggtaggggttgggtagtacgttacaaccgttccgaacgtttaccggttaccggttaaccggggtaaaccgttaccgggggtaacccgtaaagggtttccccgttaccccggttacccgttaaccggtccccgaaaccgaccccggaaccgggaccccctaaaccccgtcttaacggttacccctaccgttaccccgttcccgttaaccccccttaacccccg

SEQ ID NO: 433058 - DNA, 560 bp, Homo sapiens
  misc_feature: GZ8MTXP01BYRK0.4.57.F02.1.454.CMB.2.raw
  modified_base (266)..(266): a, c, t, g, unknown or other
  modified_base (393)..(393): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatggggtgcagttatagtggtttgataggaaactaanaaattctatgcagactccgtagaacgggccattcaccatctccagagactaatttcgagaacacatttagaatctaacagatacgaactagtctaggagaagccgaaggcacgggtctgtcttattnttgtgcgagagtagtgtctagtgttcctttgaccgaggtcgggacgacgggaacccgtggtcaccgtctctcacgcttccaccgtacggcccacgtccgtcctccccgcggtccgcccgtcgccttcgcggacgcaccgtcggtcggggcacggcggccggtcccgg

SEQ ID NO: 433059 - DNA, 582 bp, Homo sapiens
  misc_feature: GZ8MTXP01BQ3XD.4.57.F02.1.454.CMB.2.raw
  modified_base (474)..(474): a, c, t, g, unknown or other
tcagagcactgtagcacgaccggtgctcgatttagctcgatatagttgggtttggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccattcacatctccagagacaatttcgagaacacatgaatctacagatgaacagtctgagagccgaggacacggctgtctattattgtgcgagagtaagtggtcagttggtccttttagaccgaaggtcggggccgagggaacccctggtccaaccgtcctcctcacggtccttaccaaccgaacgggccccctagtccgggttccccttcccccgtgggcccgtcccgtcgccgtcccgaggaccncacccgtcgtcgggggccaacgcggccggcccgtcgggctcgccgttgggtacacgggtacctaccttcccgcgacgtcgctcgtcggacgcgggtccttgggaaccg

SEQ ID NO: 433060 - DNA, 548 bp, Homo sapiens
  misc_feature: GZ8MTXP01EN7HL.4.57.F02.1.454.CMB.2.raw
  modified_base (221)..(221): a, c, t, g, unknown or other
  modified_base (363)..(363): a, c, t, g, unknown or other
  modified_base (426)..(426): a, c, t, g, unknown or other
  modified_base (541)..(541): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacgcaggatactgtgtggacngcagtcggaaggtaaaagtgtacattggtacaggcagaagccaggccacggcccctggtggtggtcgtccgttatgatacgcgaccggccctcgagggactcccgtgagcgattcctcgtggctccaactcgtacgggaacncgggcccaccctgaccatcacgcgagggtcgaaggccggggatggacggccgactagttacgngtacgagggtggtgggggtataggtagtggtgatcatcctagtccgtcgtacggaacgtcgggacaggtcccttccgtctacgttcgcgacccaaggcccaactccacttcgtcncttcccg

SEQ ID NO: 433061 - DNA, 618 bp, Homo sapiens
  misc_feature: GZ8MTXP01CP74M.4.57.F02.1.454.CMB.2.raw
  modified_base (395)..(395): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataactgtgtggaaccagcaatcgggaaggtaaaagtgtacattggtacaggcagagccaggccaggccctggtggtggtcgtccgttatgatagcgacccggcccgcgtaggacgtccctggagcgtacgttctcgtcggtccgtaccacgtacgtcgggaaaccgaccggcccaccctacgactacncaggcgacgggtacggacggaccggggtagcgaggaccggacttagttactggcgaggtgtgggtagtgggttaggtggtgagtacagtacctagttaaccgtcgttaccggaaacggttcgggaacccgtaaacgggttccttacccggttaccgttacgtaaccgcgaccccgacgaccccaaccccgtactcgtactaccttcctcgttccctaaccccc

SEQ ID NO: 433062 - DNA, 526 bp, Homo sapiens
  misc_feature: GZ8MTXP01CBVP2.4.57.F02.1.454.CMB.2.raw
  modified_base (418)..(418): a, c, t, g, unknown or other
  modified_base (431)..(431): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcagatacctgtgtggaccagcagtcggaaggtaaagtgtacagttggtacaggcagaagccgaggccaggcccctggtggtggtcgtccgttatgatacgcgaccggcctcgagggctccctgagcgattcctctggcctccaactcgtagggaaccacggcccaccctgaccatcagcgagggtcgaaggccgggatggaggcagactatacngtcgaggtggggngggtataggtggtggtgatcactcgtatcgtcttggaactgggactacgggttctccgtcttacgcacgccgaagccaactccactcgttcgtcc

SEQ ID NO: 433063 - DNA, 662 bp, Homo sapiens
  misc_feature: GZ8MTXP01BOLWM.4.57.F02.1.454.CMB.2.raw
  modified_base (312)..(312): a, c, t, g, unknown or other
  modified_base (389)..(389): a, c, t, g, unknown or other
  modified_base (530)..(530): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgccaccctcagtgtcaggtcggccccgagggcagacggccaaggataaccgtggtgtgggaaccagcagtcgggaaggtaaaagtgtacagttggtacaggcaagaacgccgaggcccacggccctggtggtcggtcgtccgttagngagtacgccgaccggcctcgagggactcccgtgagcgtattcgtcgtcggcctaccaacgtcgtacgggaaaacccncccgggcccacccgtcgaaccctacgtaccgacggcgacggggtaccgaacggggccggggagtacgggaacggacccgtaacgttacgttaccgtggtacggaaggggttggtaggggtagttaggggttaggtgggtanagttcgactcgtaacgttaccgttcgttacgggaacgtcgggaacctaacggttccttaccgtaccgttacgtccacggaccccgaacggaccccaacccgagtcgtcctacttcctccgttcccctaaccc

SEQ ID NO: 433064 - DNA, 556 bp, Homo sapiens
  misc_feature: GZ8MTXP01B8FUU.4.57.F02.1.454.CMB.2.raw
  modified_base (175)..(175): a, c, t, g, unknown or other
  modified_base (219)..(219): a, c, t, g, unknown or other
  modified_base (298)..(298): a, c, t, g, unknown or other
  modified_base (335)..(335): a, c, t, g, unknown or other
  modified_base (383)..(383): a, c, t, g, unknown or other
  modified_base (427)..(427): a, c, t, g, unknown or other
  modified_base (433)..(433): a, c, t, g, unknown or other
  modified_base (438)..(438): a, c, t, g, unknown or other
  modified_base (455)..(455): a, c, t, g, unknown or other
tcagagcactgtagcacgaccggtgctcgatttagctcgatataggttggggtttgggggcctaaggaagcagcactggtggtgcctcagccatggcctggaccgttctcctcctcggcctcctctctcactgcacaggctctgtgacctcatatgtgctgactcagccaccctnagtgtcagtcggcccagggcagacgcaggatactgtgaggaacngcagtacggaaggtaaagtgtactagtggtacaggcagaacgccgaaggcccaggcccctggtcggtggtcgtcgttangatagcgacccgcctgaggactccctgagcgtattcncgtcggcctacaactcgacggggaaacaccggcccacccgtgacccancaggcgtaagggcgaaaggccgggaatcgacggcaacttatacngtacgnggtgnggatagggtgtggtacnttacatccagtaacgtcgtacggaactgggacctaaggtccttacggtccttacgcgacgccgacggaccctaacccatcgcacttctccgttcccaaccc

SEQ ID NO: 433065 - DNA, 628 bp, Homo sapiens
  misc_feature: GZ8MTXP01EW5P6.4.57.F02.1.454.CMB.2.raw
  modified_base (226)..(226): a, c, t, g, unknown or other
  modified_base (295)..(295): a, c, t, g, unknown or other
  modified_base (364)..(364): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggccctgtgacctcatatgtgctgactcagccaccctcagtgtcagtggccccaggcagacggccaggataacctgtgtgggaaccngcagtcggaaggtaaaagtgtacattggtacaggcagaagccaggccaggccctgtggtgtcgtcgtangatagcgaccgcctgagggactcccgtgacgcgtattctccgtcggctaccaactcgtaacgggaaccnccgggacccacccgtgaccctagtccgagccgaggggtcgaacggccgggggatcgggacggacccgtaattacgttaccgtggtacgaagggttggtaggggtagttaggttaacgggtggtaggaactcgactaccgaagttaccggtcgttaccgggaaacgtcgggggaacctaacgggttccgtcccgttaccgtacggtcaccggcccaaacgggccctaaacctccctaacgttcgttacctccgttccgttccccg

SEQ ID NO: 433066 - DNA, 563 bp, Homo sapiens
  misc_feature: GZ8MTXP01CT817.4.57.F02.1.454.CMB.2.raw
  modified_base (361)..(361): a, c, t, g, unknown or other
  modified_base (462)..(462): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggcaggataacctgtgtggaaccagcagtcgggaaggtaaaagtgtaacattggacaggcagaagccaggccaggccctgtggtggtcgtcgtatgatagcgaccggcctcgagggactcccgtgagcgattctcgtcggcctacaactcgtagggaaaaccncggccaccctgacccatcgagcgagggtcgaaggccggggatggacggacccgtaagttacgttacgtgtacgagggtgtaggggataggggtagtggtanatcatccagtacgtctacggactggaccaaggtccttccgtccttacgtcacgaccccgaggccccaaaccctcgtcgtaccacttctccgttcccgtccc

SEQ ID NO: 433067 - DNA, 657 bp, Homo sapiens
  misc_feature: GZ8MTXP01BOBPP.4.57.F02.1.454.CMB.2.raw
  modified_base (178)..(178): a, c, t, g, unknown or other
  modified_base (218)..(218): a, c, t, g, unknown or other
  modified_base (289)..(289): a, c, t, g, unknown or other
  modified_base (302)..(302): a, c, t, g, unknown or other
  modified_base (313)..(313): a, c, t, g, unknown or other
  modified_base (327)..(327): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctnagtgtcagtcgcccaggcagacgcagatactgtgaggacngcagtcggaaggtaaagtgacagttggacaggcagaacgcaggccacggccctggtggtggtcgtcgttangatgcgacggccncgaggactccngacgcgtattcccncgtcggcctacccaacgtcgtacgggaaccacccggaccctacccgtagaccctagacgacgaccggaaggggtaccggaaacggggcccgggggtaaatcgggaaccggtacccggtaaacttacgtttaacgtcggtaacgagggttgggaggggggacgtttaaggggtaggtggggttaatacgttacgtacgtaccgtacgttaccgtaccggttaacgggaacgtaacggggtaaccgttaccggtcccgttacccgttaccgtacgaccgacccgaacccgaacggaccctaacccgtccgtacttcgtaaccgttccgtccg

SEQ ID NO: 433068 - DNA, 583 bp, Homo sapiens
  misc_feature: GZ8MTXP01EAH6Z.4.57.F02.1.454.CMB.2.raw
  modified_base (223)..(223): a, c, t, g, unknown or other
  modified_base (369)..(369): a, c, t, g, unknown or other
  modified_base (484)..(484): a, c, t, g, unknown or other
  modified_base (557)..(557): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcagtcgggaaggtaaaagtgtacagttggtacaggcagaagccaggccaggccctgtggtggtcgtcgtatgatagcgaccggcctcgagggactcccgtgacgcgtattctcgtcggcctaccaactcgtacggggaaaacccnccgggcccacccgtgaaccccataccgaggcgaaggggtcgaaagggccggggatcgggacggcccgtaacttattactggtacgagggtgtagggatagggtaggtggtgactnatccagtacgtcttacggaactcggggaccaagggtcttccgtaccttacgcacgcccgaggccccaacccgntcgtcacttctccgttccccgtcccc

SEQ ID NO: 433069 - DNA, 594 bp, Homo sapiens
  misc_feature: GZ8MTXP01EUNNN.4.57.F02.1.454.CMB.2.raw
  modified_base (149)..(149): a, c, t, g, unknown or other
  modified_base (409)..(409): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcagcccaccctcagtgtcagtcggccccgagggcaggacggccaggataacctgtgtaggaaccagcagtacgggaagtaaaagtgtaacattggtacaggcagaagccaggccaggccctggtggtggtcgtccgtatgatagcgaccggccctcgagggactcccgtgagcgtattctctcggctacaactcgtagggaaaccacgggcccaccctgacccatcagcgagggtcgaaggcggganggacggccgatattactgcgaggtggtagggagtaggggtacggttggtagtagtctactaccgtagttaccgttcgttaccggaacgtcgggaacccgtaagtccgttcccgtccttacgtaccgacgaccccgacggccccaaccccgatccgtctaccgttccttccgtttcccccaacccc

SEQ ID NO: 433070 - DNA, 582 bp, Homo sapiens
  misc_feature: GZ8MTXP01B5AA4.4.57.F02.1.454.CMB.2.raw
  modified_base (363)..(363): a, c, t, g, unknown or other
  modified_base (378)..(378): a, c, t, g, unknown or other
  modified_base (450)..(450): a, c, t, g, unknown or other
  modified_base (487)..(487): a, c, t, g, unknown or other
  modified_base (526)..(526): a, c, t, g, unknown or other
  modified_base (532)..(532): a, c, t, g, unknown or other
tcagagcactgtagcacgaccggtgctcgattagctcgatatagttgggtttggggggaagaggaagactgacggtcctcccaggagttcaggtgctgggcaccgtgggcagtggggggaggcgtggtccagccgtggggggtccctgagactctcctgtgcagcgtctggattcgccttcagtgcctatggcatgcacgtgggtccgccgaggctccgaggcgaaggggctagggaatggggtgctagttatagttgggtttgagtaggaaactaactaaattctatgacagactccgtagaacggccgtatcaccatcctacgagagactaagtttacgaagaacactattagaatctaanagatacgaacagtcngagaagaccgaagacgacgtctgtactattagtgtgacgtagtagtagtgtacagttcgttactttgaccgngggtcgggacgacgggtaccgtggtccaccgtctccngcgcctaccacgtacggtccctacgtccgtcctccccgnggcccnccgtcgccttcgcggacgccgtaccgtcgcggggccacgcggccgtccgg

SEQ ID NO: 433071 - DNA, 569 bp, Homo sapiens
  misc_feature: GZ8MTXP01ATQ32.4.57.F02.1.454.CMB.2.raw
  modified_base (303)..(303): a, c, t, g, unknown or other
  modified_base (524)..(524): a, c, t, g, unknown or other
  modified_base (563)..(563): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtagggaaccagcagtcggaaggtaaaagtgtacattggtacaggcagaagccaggccaggcccctggtggtggtcgtcgttangataggccgaccggccctcgaggggactcccgtgacgcgtacttcctctggcctaccaactcgtacgggaaccaccgggcccaccctcgaccagtcagcgagggtacgaagggccggggatggacggaccgtactaagttacgtgtcgagggtggagggggtataggtaggtggtgagtcatcccagtaccgtcgtacggacgtgggaaccttagggtccncgtccgtacgttcgcgaccaagccaactccagttcgtcncgtccc

SEQ ID NO: 433072 - DNA, 568 bp, Homo sapiens
  misc_feature: GZ8MTXP01CK2KL.4.57.F02.1.454.CMB.2.raw
  modified_base (358)..(358): a, c, t, g, unknown or other
  modified_base (416)..(416): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggacaggcagaagcaggccaggcccctgtggtggtcgtccgtatgatagcgaccggccctgacggctccctgagcgacttcctctggcctccaactcgtagggaacncggcccacctgaccatcagcgagggtacggaggccggggatggacggcgactattacngtcagggtgtgggggtataggtagtcggtgatcgactccatacgtcttacgggaacgtcgggtacccaagggttcccttccggtacccgttacgttccgacgttccccgaagggcccctaaacctcccgtaacttcggtcccaactttcccg

SEQ ID NO: 433073 - DNA, 665 bp, Homo sapiens
  misc_feature: GZ8MTXP01B8Z6J.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggccaggataacctgtgtaggaaccagcagtacggaaggtaaaagtgtactagttggtacgaggcaagaacgccgaggccacggccctggtggtgtcgttcgttagtgtatagccggaccggccctacgacggacgtccctgacgcgtactcgtcgtcgcctactaccgtcgtaggaaaccaccgccgaccctcgaccactcgacggcgtacgggtacggaacggaccgggaggtaggacggaccgtaacgttacttaacgtcgtacgtagggttagggtaggttaagggttaggggttaggtggggttacgtacgtacgtacgtaccgttagtaccgttcggttaccgggtaacgtacgggtaaccgaacggttccgttcccgtaccgttaccgtacgaccgacccgttaccggaccctaaccccgacgtcgttaccacttcccgtcccgttcccgtaaccccc

SEQ ID NO: 433074 - DNA, 766 bp, Homo sapiens
  misc_feature: GZ8MTXP01B3EPP.4.57.F02.1.454.CMB.2.raw
  modified_base (179)..(179): a, c, t, g, unknown or other
  modified_base (223)..(223): a, c, t, g, unknown or other
  modified_base (300)..(300): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctnagtgtcagtcggccccaggcagacggcaggatactgtgaggacngcagtacggagtaaagtgtacagttggacaggacagaacgccgaggccgacggcccctggtcggtggtcgtcgttangactacggccggacccggccctagagggtacctcccgtagacggcgtattccccgtcgtacggtcctacccgtaactccggtaacggggaacccacccgggcccctaacccgtacggaacccctagtacggaaacggccggtaacgggggtacccggaaaacgggggccgggggtaaagtacggggaaccgggtacccggtaaactttaacggttaccgtagggttaccggtagggggttacgggtaggggggtaagtttaaacggggttagggttcgggtaagtaactcccgtaacgtttacccgaacgtttaaacccgggtttcggttaccggggtaaaccggttcgggggaaacccttacgggggttcccttacccggggttaccctacccggttacgaacccggttaccccgaaacggtcccctaaccggtcctacgttccgtaacccttaaccgtttcccg

SEQ ID NO: 433075 - DNA, 670 bp, Homo sapiens
  misc_feature: GZ8MTXP01EIZ3J.4.57.F02.1.454.CMB.2.raw
  modified_base (207)..(207): a, c, t, g, unknown or other
tcagagcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcacgtgggtccnccaggcctccgagggcgaaggggctagggaagtggggtgctagttatagttggtttgataggaaactaaacaaattctatgcagactcgtgaagggccgattcaccatctaccagagactaattacgaagaacactattgaattactacaagatacgaactagtctagacgaacgaccggaaggacacgggtctagtacttagttagttgtagacgtaggtaaggtagtggtactagttcggtttccgtttacggacgtagggtcggggaccgacggggtaacccggttggtcctaccggttctaccgtcgacgtccttacccgaacgtaccgggtccctacgttcccgggttcccttcccccggttgggtccccgttcccgtcggtcccttacccggttacgggaccgccgtacccgtcgggggtaccgggggccaaccggccgggttcccgggtccccggg

SEQ ID NO: 433076 - DNA, 710 bp, Homo sapiens
  misc_feature: GZ8MTXP01ACH6U.4.57.F02.1.454.CMB.2.raw
  modified_base (226)..(226): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggcaggataacctgtgtgggaaccngcagtcggaaggtaaaagtgtacattggtacaggcagaagcaggccaggcccctgtggtggtcgtccgtatgatagcgaccggccctgagggactcccgtgacgcgtattcccgtctggctcccaaactccgtacggggaaccaccgggcccaaccccttggaaccctacgtaccgaggaccgaggggtaccgaaacgggcccgggggaatcgggaacggggcccgtaacttaacgtttaccgtaggttccgaaggggttgggtaggggggtaattaaggggttaggtacggggtagtaacttcgaacttccccgtaaagttaccggttaccgttaccggggaaacgttcgggggaaaccccgttaaaggggttccccgttacccgttaccccgttaacggttcccgaaccgttaccccgaaaccgggtccccaaaaccctttccccgaaacccgttcgggttaaccccaaccgttttcccccg

SEQ ID NO: 433077 - DNA, 672 bp, Homo sapiens
  misc_feature: GZ8MTXP01DOASD.4.57.F02.1.454.CMB.2.raw
  modified_base (301)..(301): a, c, t, g, unknown or other
  modified_base (333)..(333): a, c, t, g, unknown or other
  modified_base (531)..(531): a, c, t, g, unknown or other
  modified_base (636)..(636): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggcaggataactgtgtggaaccagcagtacgggaagtaaaagtgtaacagttggtacaggcaagaagccaggccacggccctggtggtggtcgtcgttangagtagccgaccggcctacgagggactcccgngagcgtattctcgtcggcctaccaactcgtacgggaaacccacccgggcccacccgtcgaacccagtaccgaaggcggtaacggggtaccggaaacggggccgggggaagtcgggaacggtacccggtaactttaacgtttaacgtggtacggtaggggttgggttaggggtaagttaagggggtaaggttggggtanacttcgactccgtagttaccggtcgttacgggaacgtcgggaaccgtaaggttccttccggtccttacgtacgaccgttaacccgacggaccccctaaacccgtntccgtcaccgttccgttcccggttaaccccgtcccc

SEQ ID NO: 433078 - DNA, 698 bp, Homo sapiens
  misc_feature: GZ8MTXP01AX9CJ.4.57.F02.1.454.CMB.2.raw
  modified_base (227)..(227): a, c, t, g, unknown or other
  modified_base (298)..(298): a, c, t, g, unknown or other
tcagagcactgtagcacgaccggtgctcgatttagctcgatatagttgggttggggctgggcctaaggaagcagcactggtggtgcctcagccatggcctggaccgttctcctcctcggcctcctctctcactgcacaggctctgtgacctcatatgtgctgactcagccacctcagtgtcagtcggccccagggcaggacggccaggataaccgtgtgtggaaccngcagtcggaaggtaaagtgtacattggtacaggcagaagccaggccaggcccctgtggtggtcgtccgtangatagccgaccggccctgagggactcccgtgacgcgattccctacgtcggctaccaactcgtacgggaaccacggcccacccgtcgacccacgtcgacggacgacggggtaccgaacggcccgggggtatacgggaacggaccggtaacttaaacgttactacgggtacgagggttaggtggggggaatttagggtaaaggtggggtagaacttccaagttacccgaagtttaacccgggtcgtttaaaccggggaaccggttaacggggtaaacccgaaacgggtttccccgttcccggtttaacccgttaacccgggttaccgaaccggaccccccgtaaaaggggtacccccaaaccgttcccaccggtttacggtaacccttaaccgttttccccg

SEQ ID NO: 433079 - DNA, 597 bp, Homo sapiens
  misc_feature: GZ8MTXP01EOGY4.4.57.F02.1.454.CMB.2.raw
  modified_base (227)..(227): a, c, t, g, unknown or other
  modified_base (298)..(298): a, c, t, g, unknown or other
  modified_base (344)..(344): a, c, t, g, unknown or other
  modified_base (391)..(391): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgcaggataaccgtgtgtggaaccngcagtcggaaggtaaaagtgtaacattggacaggcagaagccaggccaggcccctggtggtgtcgtcgtangatagcgaccggccctcgagggactcccgtgacgcgtatttccccncgtcggcctcccaactccgtagggaaccaccggcccaccctgaccancagcagggtacgaaggccggggatggacggccgacttacgtactcggtacgagggtggtgggggtattaggtaggttggtaggactcgtatacccgtataccggttcgttacggaacgtcggggaacttacgggtcccttccgtccttacgccgttcgaccccaacgggccctaaaccgtcctacgttcgtccttaacgtttcccg

SEQ ID NO: 433080 - DNA, 574 bp, Homo sapiens
  misc_feature: GZ8MTXP01A2P2T.4.57.F02.1.454.CMB.2.raw
  modified_base (351)..(351): a, c, t, g, unknown or other
  modified_base (449)..(449): a, c, t, g, unknown or other
  modified_base (548)..(548): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggagtaaagtgtacattggacaggcagagcaggccacggccctgtggtgtcgtcgtatgatagcgaccggccctcgaggactcccgtgacgtcgattctctcggcctcaactcgtggaaaccncggccaccctgaccatcagcgacgggtacgaaggccggggatcggacggccgtaactagttacgtgtcgagggtgtaggggtataggggtagtgggtnacgttcgatccgagttaccgtcgttacgggaactcggggacctaacgggtcttcccgtccttacgtcgacgaccccgaacggcccctaaccccacgtcnctaccttcttccgttccccgtccccg

SEQ ID NO: 433081 - DNA, 633 bp, Homo sapiens
  misc_feature: GZ8MTXP01AOGIZ.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcacgtgggtcccgccaggctccgaggcgaagggggctgggaatggggtggctagttatagtggtttgataggaaactaacaaattcatgcagactcgtagaacgggccatcaccatcctacagacgactaatttcgaagaacactattagaactctaacagaatagaaactagtctaggaaagacgccggaagggaaccacgggtcttagtacttaatttagttgtagacggtaagtagttaagtggtactagttcggttctttacggaccgtagggtcggggaccgtaacggggggtaacccttgggtcctaccggtctccgtcgacgtcctaccgaccgaacgggccctagtcccggtcccttccccgtcggcccgtcccgtcgcccgttccgacggtcgcccgtaaccgtcggcggggccaacgcggcccgg

SEQ ID NO: 433082 - DNA, 621 bp, Homo sapiens
  misc_feature: GZ8MTXP01CWCCY.4.57.F02.1.454.CMB.2.raw
  modified_base (174)..(174): a, c, t, g, unknown or other
  modified_base (223)..(223): a, c, t, g, unknown or other
  modified_base (296)..(296): a, c, t, g, unknown or other
  modified_base (482)..(482): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagccaccctnagtgtcaggtcggcccgagggcagacggcaggataactgtgaggaaccngcagtacgggaagtaaagtgtacagttggacaggcaagaagccaggccaggccctggtggtggtcgtcgttangatacgcgaccggcctacgagggtactcccgaggacgcgtattcgtcgtcggcctacaactcgtaggaaaccaccggccaccctgaaccacgtcgagcgaggggtacaacgggccgggatcgggaacggacccgaattacgtacgtggtacgaagggtggtaggggtattagggggtaggtgggtnagtactacgtacctagttaacggtcttaaccggggtaacgtcggggtaacctaaagggtccttccggtaccttaccgtacgacgacccgaacggaccccaaccccagttcgacctacttccgtccgttcccctaacccc

SEQ ID NO: 433083 - DNA, 710 bp, Homo sapiens
  misc_feature: GZ8MTXP01CVROD.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtaacagttggtacaggcaggaacgccaaggccacggcccctggtggtggtcgtccgttatgataggcgacccggccctcgaggggactccccgtggacgcgtactttcccgtctcgggcctacccaaacgttccgtacggggaacccacccgggccccaaccccgttaggacccctacgtaccgacggccgaacgggggtaccgaaacggggcccgggggaaagtcgggaacggggtacccgtaacttaacgtttacccgtggtaccgtaaggggtttgggtaggggggtaagttaagggttaggtggggtacgtaatccgtattacccgtattaccggtccgtttaccgggaaacggttcggggtaaaccaaggggttcccttcccggttaccgtaaccgttccgaaccggaccccaacgggtacccaaccgtccacgttccgtaaccaaccgtttcccg

SEQ ID NO: 433084 - DNA, 803 bp, Homo sapiens
  misc_feature: GZ8MTXP01BR762.4.57.F02.1.454.CMB.2.raw
  modified_base (225)..(225): a, c, t, g, unknown or other
  modified_base (303)..(303): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggataactgtgtggaaccngcagtcggaaggtaaaagtgtacagttggtacaggcaaggaacgccgaggccacggcccctggtggtggtcgtcgtangatacggcgacccggcctcgagggtactcccgtggacgcgtattccccgtcgtcggcctacccgtaaaccgtccgtaacggggaacccgtacccgggacccctaaccccgtacggaacccctaacgtaccggaaacgggacccgggtaaacgggggttaacccgggaaaaccgggggtccccggggggtaaattacgggggaaaccggggtaccccggtaaactttaacgtttaaccggtcggttaccggtaacggggtttcggggtaacgggggggttaagtttaacggggttacgggttacgggggtagtaacttccggtaactttaccccggtaagtttacccgggtttaccgtttaaccggggaacccggttaacgggggaaacccttaaacggggttccctttacccggtacccgttaccggttaccgaccggttaccccgaaacgggcccctaaaccttccccgaacgtttccgtcccgttaaccctttccccg

SEQ ID NO: 433085 - DNA, 703 bp, Homo sapiens
  misc_feature: GZ8MTXP01C5WP5.4.57.F02.1.454.CMB.2.raw
  modified_base (177)..(177): a, c, t, g, unknown or other
  modified_base (300)..(300): a, c, t, g, unknown or other
  modified_base (344)..(344): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctnagtgtcagtcggccccaggcagacggcaggataacctgtgtaggaacagcagtcggaaggtaaagtgtaacagttggacaggcaagaagccgaggccacggccctggtggtcggtcgtcgtangactacgcgaccgccgtgacggctccgagacgtcgtacttcccncgtcggctacctaagttcgtacgggaacccgccggccctaacccgtacgaccactacgacggaccgtaggggtaccggaacgggccgggggaatcgggaccgggtaccgtaacttacgttacgtcggttcggtaaggggttgggttaagggggtagtttaaggggttaacgggttgggtaagtaactccgtaacgttacccgtaacgtttaccgggttccggttaaaccggggaacggttcgggggtaaacccttacgggggttaccccgttccccggttacccgtacgttacccgaaccggaacccccgtaacggacccctaacccttcccgacttacgtcccttaaccgtttccccg

SEQ ID NO: 433086 - DNA, 638 bp, Homo sapiens
  misc_feature: GZ8MTXP01AZ5GB.4.57.F02.1.454.CMB.2.raw
  modified_base (437)..(437): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtaacattggtacaggcaggaagccaggccaggcccctggtggtggtcgtccgttatgatggcgacccggcctcgagggactccctggagcgattccctcgtggtcctaccgaacctcggtacgggaaccgaccgcccctaacccgtcgacccagtacgacgcggagggtacggaacgggccggggtanacgggacggaccgtaacttacgttacgtgtacgtagggtgggtagggggtagtagggttaggtggtagtactctacgttaccgtaacgtaccgtttccggtaacggtaacggtaacgggtaaccgttaacggtccgttcccgtacctacggttacgccgacccgaacgacccaactcccacgttcgtccttaacgttcccg

SEQ ID NO: 433087 - DNA, 648 bp, Homo sapiens
  misc_feature: GZ8MTXP01CIMI4.4.57.F02.1.454.CMB.2.raw
  modified_base (303)..(303): a, c, t, g, unknown or other
  modified_base (471)..(471): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggccccgaggcagacggcaggataacctgtgtggaaccagcagtcggaaggtaaaagtgtacagttggaacaggcaagaacgccgaggccacggcccctggtggtggtcgtcgttangatagcgacgccctgaggctccgtgacgcgtattccccgtgtaggcctaccaaacgtcgtacggggaaccacccgggtacccacccgtcgaccctaagtcaacggcgaacggggtaccgaaaggggcccgggggaatcgggacggtacccgtaacttagtttaacggngtacggtagggttggtagggggtaagttagggttagtaggtagtaactcgtactccgtaacgttaccgttacgtacgggaacgtaacgggtacgttacggttcccgttaccgtaccgtacggaccgaccgacccgaacggaccctaaccgtcctacgttccgtaaccgttccttccg

SEQ ID NO: 433088 - DNA, 646 bp, Homo sapiens
  misc_feature: GZ8MTXP01EOUYE.4.57.F02.1.454.CMB.2.raw
  modified_base (309)..(309): a, c, t, g, unknown or other
  modified_base (385)..(385): a, c, t, g, unknown or other
tcagagcactgtagcacgaccggtgctcgatttagctcgatataggttggggtttgggggcctaaggaagcagcactggtggtgcctcagccatggcctggaccgttctcctcctcggcctcctctctcactgcacaggctctgtgacctcatatgtgctgactcagccacctcagtgtcaggtcggcccgagggcaggacggccaggactaaccgtgtgtacgggaaccagcagtacgggaaggtaaaagtgtacagttggaacaggcaagacgccgaggccacggccctggtggtggtcgtcgttangatacggccgaccggccctggagggactcccgtgagcgtattctcgtcggcctacgaactcgtacgggaaaacccncgcccacctgaccagcgaggcgacgggacgaacggcgggagtcggacgacgtaacgttagtacgtggacgagggtggtaggtagttacggggtaggtggtatactacgtacgtacgtagttaccgttacggtaacgggtaaccggtacgggaaccgtaacgggttcccgttacccgtaccgttacgtaccgaaccgaacccgaaccggacccctaaacccgtcgttccgtaccaccgttcccgttcccgttaacccctccc

SEQ ID NO: 433089 - DNA, 609 bp, Homo sapiens
  misc_feature: GZ8MTXP01DVR79.4.57.F02.1.454.CMB.2.raw
  modified_base (318)..(318): a, c, t, g, unknown or other
  modified_base (329)..(329): a, c, t, g, unknown or other
  modified_base (346)..(346): a, c, t, g, unknown or other
tcagagcactgtagcacgaccggtgctcgattagctcgatatagttgggtttggggggaagaggaagactgacggtcctcccaggagttcaggtgctgggcaccgtgggcatgggggaggcgtggtccagccgtggggggtccctgagactctcctgtgcagcgtctggattcgccttcagtgcctatggcatgcactgggtccgccaggctccaggcaagggggctgggaatggggtggcagtttatattgggtttgagtaggaaactaaacaaattctaatgacagactccgtgaagggccatcaccatctcaganactaattcganaacacattgaatctaanagatacgaactagtcgtagagaacgaccggaagacgacggtctagtacttattagttgtagagaagtaagtaagtgtatagttcgttcttagacgtagggtcgggaccgacgggtaccgtcggtacctaccgtcctacctcgacgtacctacccgaccgtaaccggaccctacgtcccgtcccttccccgttcggtcccgttcccgtcgtccgttaccggcggaccgtcctaccgtcggcgggccaccggtcggcccggtccg

SEQ ID NO: 433090 - DNA, 616 bp, Homo sapiens
  misc_feature: GZ8MTXP01EXHGQ.4.57.F02.1.454.CMB.2.raw
  modified_base (221)..(221): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgngggaaccagcagtcgggaaggtaaaagtgtacattggtacaggcagaagccaggccaggcccctggtggtggtcgtccgttatgatagcgaccggcctcgagggactcccgtggacgcgatttccctcgtggcctccaactccgtagggaaccaccgggcccacccgtgacccatcagcgagggtcgaaacggccggggatcggaacgggcccgaacttacgttaccgtgtcgtaagggtgggtagggggtagttaaggtaggtgggtgtagtcctaagtcctaagttaccggttcgttaccgggaacgtcggggtaaccaagggttccttcccggtccgtacgttccgacgccccgaacggcccaacctccgacttcgtccttaaccgttcccg

SEQ ID NO: 433091 - DNA, 546 bp, Homo sapiens
  misc_feature: GZ8MTXP01EVLQ7.4.57.F02.1.454.CMB.2.raw
  modified_base (323)..(323): a, c, t, g, unknown or other
  modified_base (400)..(400): a, c, t, g, unknown or other
  modified_base (403)..(403): a, c, t, g, unknown or other
  modified_base (414)..(414): a, c, t, g, unknown or other
  modified_base (505)..(505): a, c, t, g, unknown or other
  modified_base (529)..(529): a, c, t, g, unknown or other
tcagagcactgtagcacgaccggtgctcgatttagctcgatatagttggggtttggggggaagaggaagactgacggtcctcccaggtgtccagtgtcaggtgcacctggtggaggtcggggggaggcgtggtccagccgtggggggtccctgagactctcctgtgcagcgtctggattcgccttcagtgcctatggcatgcacgtgggtcccgccaggctccgaggcaaagggggctggaatggggtgcagttatatggtttgataggaaactaaacaaaattctaatgcagactccgtgaagggccatcaccatctcaganacaatttcgagaaacacattgaaatctaacagaatgaaacagtctagaagagccgagacaggctgtctattatgtgnganagtaatggtanattggtcctttgaccaggtgggcagggggaaccctggtacaccgtctcctcagtcctccaaccaaagggccccaagtccggtcttccccgnggccgccctgccgcgacgaacgcncgcgtcgggcgcgcgcg

SEQ ID NO: 433092 - DNA, 655 bp, Homo sapiens
  misc_feature: GZ8MTXP01A8ZQH.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccagcagtacgggaaggtaaaagtgtaacagttggtacaggcagaagccaggccaggcccctgtggtggtcgtcgtatgatagcgaccggccctcgagggactcccgtgacgcgattctctcggcctcaactcgtagggaaaccacgggcccaccctgaacccatcgacgcgacggggtacgaaggcccgggggatcggacggacccggtaacttagttaccgtggtaccgtagggtggttaggggaagttagggggtagggttgggtagacgttcgaacgttccgtaagttaccgtcgtttacgggaaaccgttcggggaacccgtaaagggttcccttacccggtcccttacggtaccaacggaccccgaacggaccccaaaacccctcgtcggttcccaaccgttcccgttaaccgttcccccgtaaccccc

SEQ ID NO: 433093 - DNA, 562 bp, Homo sapiens
  misc_feature: GZ8MTXP01DZ62B.4.57.F02.1.454.CMB.2.raw
  modified_base (555)..(555): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccagcagtcgggaaggtaaaagtgtacagttggtacaggcagaagccaggccaggcccctgtggtggtcgtccgtatgatagcgacccggccctcgagggactcccgtgagcgtattccctcgtggcctcccaacctcgtacgggaaccaccggcccaccctgacccatcagcgaggggtcgaacggccggggatggacggccgtaactattacgtgtacgaggtggtgggggataggtaggtgtgatcatccatcgtcgttacggaactggggacaggtccttccgtaccgtcgttcacgccccgaaggcccaacgtccacttcgtccncttcccg

SEQ ID NO: 433094 - DNA, 586 bp, Homo sapiens
  misc_feature: GZ8MTXP01DUCXH.4.57.F02.1.454.CMB.2.raw
  modified_base (178)..(178): a, c, t, g, unknown or other
  modified_base (224)..(224): a, c, t, g, unknown or other
  modified_base (339)..(339): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctnagtgtcagtcggccccagggcagacgccaggatactgtgtggaacngcagtcgggaagtaaagtgtacattggacaggcagaacgccaggccacggcccctggtggtggtcgtccgttatgactacgcgaccggcctcgagggactccgtgagcgattccncgtgctccaactcgtagggaaccacggcccaccctcgaccatcgagcgagggtcgaaggccgggatggacggccgtatagtactgtcgagggtggtagggggtaagtggttaggtgtagctcgaagtcctattaccgtctttacgggaacgtcgggaaccgttaaggtcccttaccgttaccgtacgttccgacgaccccgaaggtacccctaacgtccccacgttcgtaaccgttccgtttccccg

SEQ ID NO: 433095 - DNA, 671 bp, Homo sapiens
  misc_feature: GZ8MTXP01C7PKP.4.57.F02.1.454.CMB.2.raw
  modified_base (348)..(348): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggcctccaggcaaggggctggaatgggtgcagttatatggttgatggaactaacaaattctatgcagactcgtgaaggccattcacatctacagagactaatttcgagaacacattagaatctacagatagaaacngtctagaaagacgccgaaggaccacgggctgtactattatgtgacgagagtaagtggtactagttcggttcctttagaccgtagggtcggggacccgaagggggggtaaccccgtgggttaccctaacccggttccttccccgtaccgacggttacccctttacccgaaacccgtaaaccggggtccccctaacgtttccccgggttcccctttccccccggttcgggccccgtcccccgttcggaccccgttcccggaacgggtaaccgcccgtaaccccggttcgggtccggggggaccctaaccggccgggtccccgggg

SEQ ID NO: 433096 - DNA, 578 bp, Homo sapiens
  misc_feature: GZ8MTXP01A6M8U.4.57.F02.1.454.CMB.2.raw
  modified_base (252)..(252): a, c, t, g, unknown or other
  modified_base (277)..(277): a, c, t, g, unknown or other
  modified_base (286)..(286): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaagtaaaagtgtacattgacnggcagaagcagccaggccctgtggngtctcgtangatgcgaccgcctgaggatcccgtgagcgtattctctcggccttaccaacgtctaggggaaaacccaccgggcccaaacccgtcgaaaccctagtccaaggccgaaggggtcgaaaggcccgggggaatcggacggtccgaacttagttaacgtgtcgtagggtgtgggtagtagggtagtgggtgatcgaatccatacgtcgtcggaacgtcgggaaccaagggtcttccgtcttaccgtcacgcccgacggcccaaccccactcgtcacttcctaacgttcccctaaccc

SEQ ID NO: 433097 - DNA, 749 bp, Homo sapiens
  misc_feature: GZ8MTXP01D8OWG.4.57.F02.1.454.CMB.2.raw
  modified_base (312)..(312): a, c, t, g, unknown or other
tcagagcactgtagcacgaccggtgctcgatttagctcgatatagttgggtttggggggcctaaggaagcagcactggtggtgcctcagccatggcctggaccgttctcctcctcggcctcctctctcactgcacaggctctgtgacctcatatgtgctgactcacgcccacctcagtgtcaggtcggcccgagggcaggacggccaggataaccgtgtgtaggaaccagcagtacggaaggtaaaagtgtactagttaggacaggcaaggaacgccgacggccgacggcccgtggtggtcggtcgtcgtangatacgccgaccggcctacggagggtactccgtagacgtcgtacttcctcgtccggacctaccgtaacgtccggtaacggggaaaacccaccccgggcccctacccgtacgaaaccccagtaccggaacggacgggacgggggtaccggaaacggggcccggggtaagtacgggaccggacccgttaagttaccgtttacgtcgggtacggttaggggtggtaaggggtagttaagggggttagggttacggtacgtaactaccgtaactaccgtaacgtttacccggttcggttaaccgggaaccggttacggggaacccgtaacggttccgttaccccgggttaccttacccggtacgaacccgaaccccgttaacggaccccctaacgaccgttccgtacccaccgttcccttaaccccgttcccctaaccccg

SEQ ID NO: 433098 - DNA, 603 bp, Homo sapiens
  misc_feature: GZ8MTXP01ASEGX.4.57.F02.1.454.CMB.2.raw
  modified_base (406)..(406): a, c, t, g, unknown or other
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccgccaggctccgaggcgaaggggctggaagtggggtgctagttatagtggtttgataggaaactaacaaattctatgcagactcgtgaaggccatcacatctcagagactaattcgaagaacactatttagaaattctaacagtatacgaactagtcgtagagaacgaccgaaggacacgggcttgtacttattagttgngacgagagtagtgtctagttcgttctttgaccgtaggtcgggaccgacgggtaacccgtggtaccgtaccgtctcctcgacgtcctacccgaccgtaacgggtccctacgttcccggtcccttcccgttggcccgttcccgtgcccttccgacggaccgcctaccgtcgggcggggacacggtcggccgggtcccgg

SEQ ID NO: 433099 - DNA, 754 bp, Homo sapiens
  misc_feature: GZ8MTXP01AZ78G.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtacattggtacaggcagagccaggccaggcccctggtggtggtcgtccgttatgatagccgaccggccctcgagggactcccgtgagcgtattcgtcgtcggcctaccaaacgtcgtcggggaaaaacccaccgggtcccaccccgtgaaccctactcgaacggcgacgggggtaccgaaacgggcccgggggtaatcgggaacgggcccgtaaacgttaagtttaccgtggttaccgtaggggttgggttaggggtaaagttagggggttaagggttggggttacgaacgttccgaacgttacccgtaagtttaaccggttccgttttaacccggggaaaccgttcgggggtaaaccccgtaaacggggtttcccttaccccgggttaccccgttaccggttacccgaaccgggacccccgaaaaccggggaccccctaaaaacccccccgtcgtaaccggttacccctaaccttcccgtttccgtttaacccccccgtaaccccccg

SEQ ID NO: 433100 - DNA, 704 bp, Homo sapiens
  misc_feature: GZ8MTXP01DDFQI.4.57.F02.1.454.CMB.2.raw
  modified_base (382)..(382): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgactcatatgtgctgactcacgccaccctcagtgtcagtcggcccgaggcagacgcagatactgtgtaggaacagcagtacggaagtaaagtgtactagtggacaggacagaacgccgacggcacggcccgtggtggtggtcgtcgtagtagatacggccgacccggccctacggagggtactcccgtaggacgcgtacttcgtccgtcggacctacgaacgtcgtacgggaaaacccncccgcccaccctagaccatcgacggcgacggggtacgacggacggggatacggacggtaccgtaaaccgttagttacgcgggttacgaaggggttgggtaggggtaaacgtttaagggggttagggttacggggttaactaacgtaccttaacgttaaccgttaaccggtttaaccgggtttaccggtaaccgggtaaacggttaccgggaaaccgttaacggttcccgttacccgttacccgttacgaaccgaacccgacccgttaaccgacccctaacccgtattccgtcctacccttcccgttccccgttccccgtccc

SEQ ID NO: 433101 - DNA, 730 bp, Homo sapiens
  misc_feature: GZ8MTXP01A18AC.4.57.F02.1.454.CMB.2.raw
  modified_base (222)..(222): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggcccaggcagacgcaggatacgtgtgtaggacngcagtacggaaggtaaagtgtacagttggacaggacagaagccgacggccacggcccctggtggtggtcgtcgtatgatagcgaccggcctacgaggtactcccgagacgcgtacttccctcgtcggcctaccgaacgtcgtacgggaaccacccgggacccacccgtacgaaccctatcgaacggccgtaaggggtaccggaaacggggcccgggggtaagtacggggaaccgggacccgtaacgttacgtttaccgtagggttaccggtaggggttcgggttaggggggtaagtttaggggtaggttacgggtagtactcgtaacgttaccgtaacgttacccggttacgttacccggggtaaacggtccggggtaaacccgttaacggggttccccgttacccggtttacccgtaacccggttacccgaaccgggttacccccgaaacggggtccccttaaacccgtcccgtaaccgttccgtaacccgttaaccctttccccgg

SEQ ID NO: 433102 - DNA, 694 bp, Homo sapiens
  misc_feature: GZ8MTXP01BVBX8.4.57.F02.1.454.CMB.2.raw
  modified_base (182)..(182): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtntcagtggccccagggcaggacggccaggataacctgtgtcgggaacagcagtcggaaggtaaaagtgtacattggtacaggcagaagccaggccacggccctggtcggtggtcgtccgttatgatagcgaccggccctcgagggctccccgtgacgcgtactttccctacgtcggtcctaccaaccgttacgttacggggaaccacccggggaaccccacccccgttacgaaccccgaagttccgaacgccggaagggggttaccggaaacggggtcccgggggaagtcggggaaccgggtacccggtaacttacgttaccgtggtacgtaagggggttggtaggggggtattagggttaggttcggggtataacgttcgaattacccgtaagttaccgttccgtttacgggaacgtcggggaaaccttaacggtccttcccggtaccgtaccgttcgaccgttcccgaaacggccctaacgtccctacggttctaacccgaactttccccg

SEQ ID NO: 433103 - DNA, 693 bp, Homo sapiens
  misc_feature: GZ8MTXP01C5B8M.4.57.F02.1.454.CMB.2.raw
  modified_base (174)..(174): a, c, t, g, unknown or other
  modified_base (216)..(216): a, c, t, g, unknown or other
  modified_base (223)..(223): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctnagtgtcaggtcggcccagggcaggacggcaggataactgtgnggaaccngcagtacgggaagtaaaagtgtaacagttggtacaggcaagaagccaggccaggcccctgtggtggtcgtcgtatgatagccgaccgccctgaggactcccgtgacgtcgattctcgtcggcctaccgaactcgtacgggaaaacccaccgggccccaacccgtgaaccctaagtccgaacggacgagggggtaccgaaacggggacccgggggtaatcgggaacgggacccgtaacttagttactggtacgagggttggtaggggaagttaggggtacggtggggtagactactaacgtccgtaagttaccggttcgttaaccgggaaacgttacgggggaaccctaaacgggttcccttacccggtaccttaccggtacccgaacggttaacccccgaaacgggaccccctaaaccccgtacgttccgtaccctaccgttcccttccggttaacccccctaacccccg

SEQ ID NO: 433104 - DNA, 671 bp, Homo sapiens
  misc_feature: GZ8MTXP01AXE2M.4.57.F02.1.454.CMB.2.raw
  modified_base (601)..(601): a, c, t, g, unknown or other
  modified_base (609)..(609): a, c, t, g, unknown or other
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccgccaggcctccgaggcgaaggggctaggaagtggggtggctagttatagtggtttagagtaggaaactaactaaattctatgcagactccggtaggaacgggccattaccacatcctaccaagagtaactaatttacgaagtaacactatttagaaatctaacgagtatacggaaactggtacgtaggaaggaacgaccggaaggaccgcggtacttgtacttaagttagttgacgagtagtaagggttaagtggtactaggtttcggtttaccgtttacgaccggtagggtacggggaccgtaacgggtaaccccggtggtaccgtacccgttctccgtcgacgtccttaacccgaccgtaaccgggccctagtcccgggtcccttccccggnggtccccnccgtacgcccgttacgcgggcctccgccgtcggtacggggccacggccggttccggcccggg

SEQ ID NO: 433105 - DNA, 741 bp, Homo sapiens
  misc_feature: GZ8MTXP01EJP0L.4.57.F02.1.454.CMB.2.raw
  modified_base (153)..(153): a, c, t, g, unknown or other
  modified_base (728)..(728): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcagcccaccctcagtgtcaggtcggccccagggcaggacgccaggactacgtgtgtaggaaccagcagtcgggaaggtaaagtgtactagttaggtacaggacaaggaacgccgacggaccgacggtccccgtggtgggttcggtccgtaccgttagtaggactacggccggacccggtccctacgagggtactcccgtagacgtcgtacttcccgtcgtacggccctacccgaaccgttaccgggtaacgggaacccgtacccgggacccctaaccccgtacgaaccctacgtacgaacggccgggtaaggggtacggaaacgggggcccggggtaagtacgggaaccgggtacccgtaacgttacgttacggtcggtacggtaggggttagggtaagggggttaagttaggggttaggttggggtataacgttctacgttaccgtagttccggttaccgttacggggaacgtaacggggtaacccttaggggttccccttaccggtcccttaacgcgaccgacccgtaacggaccctaaccgtccacgttccgttaaccnccgtttaaccccg

SEQ ID NO: 433106 - DNA, 708 bp, Homo sapiens
  misc_feature: GZ8MTXP01AJP46.4.57.F02.1.454.CMB.2.raw
  modified_base (374)..(374): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtagggaaccagcagtacgggaaggtaaaagtgtacattggtacagtcagaagccaggccacggccctggtggtggtcgtcgttatgatcgcgaccggcctacgagggactcccgtgacgcgtattctcgtcggccttaccaactcgtacgggaaacccnccgggcccacctcgaaccctatcgaacggcgtaacggggtaccggaaacgggcccgggggaatacggggacgggtaccccgaacgtttaacgttacggttggtccgtaagggggttggttagggggtaagttaggggggtaggttcggggttagtacgtactactacccgtaagtttacccggttcgttaaccggggtaacgtcggggaaccctaaacgggttcccttcccggttacccgttaccgtccgaaccggacccccgttaacgggaccccccctaaaccccgtacttcggtccctacccgttccttaacccggttccccctaaccccc

SEQ ID NO: 433107 - DNA, 533 bp, Homo sapiens
  misc_feature: GZ8MTXP01B8IKT.4.57.F02.1.454.CMB.2.raw
  modified_base (221)..(221): a, c, t, g, unknown or other
  modified_base (526)..(526): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacgcagataactgtgtggacngcatcggaggtaaagtgtacattggtacaggcagaagccaggccaggcccctgtggtggtcgtccgttatgatagcgaccggccctcagggactccctgagcgattcctctggctccactctcgggaacaccggcccaccctgaccatcagcgagggtcgaggccggggatcggaggccgtactattacgtgtcgagggtgtagggggattaggtagtggtgatcgatccatacgtcgttcggaactgggaccttaggtcttccgtcctcgttcgcgcccaaggcccaacgtcccacttcgtccncgttccg

SEQ ID NO: 433108 - DNA, 694 bp, Homo sapiens
  misc_feature: GZ8MTXP01B28WL.4.57.F02.1.454.CMB.2.raw
  modified_base (225)..(225): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacccttagtgtcagtcggccccagggcagacggccaggataaccgtgtgtggaaccngcagtcgggaagtaaaagtgtacagttggacaggcagaagccaggccacggccctggtggtggtcgtcgttatgatagcgaccggcctgagggtactcccgtgacgtcgtattcctcgtcggcccctcccaaacgtccgtacggggaacccacccgggccccaacccgtcgaacccagtccgaaggccggaaggggtaccgaacggggcccggggatgggacggccgtaacttacgttacgtgtcgagggttgtagggtataggttagggtgggttagatacacgttaccgaagttaccggttaccgttacgggaaaccgtacggggtaaacccgtaacgggttcccttacccggttacccgtacccggttaccgaacccggtaaccccgaaacgggcccccttaaacccccgtgttccgtaacctacccttccgttcccgtttaaccccccaaccccgtttaaccccg

SEQ ID NO: 433109 - DNA, 674 bp, Homo sapiens
  misc_feature: GZ8MTXP01ARFO7.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccagcagtcgggaaggtaaaagtgtacattggtacaggcagaagcaggccaggcccctggtggtggtcgtccgttatgactgcgaccggccctcgagggactcccgtgagcgtattccctcgtggcctcccaactcgtacgggaaccgtacggacccacccgtcgacccgataccgagccgaggggtaccggaacgggcccgggggatcggggacgggaccgtaacgttagttacgtggtacgaggggttcgggtaggggggtaagttaggggtaggttagggtgacgttaccgtaagtacccctaagttacccggtttccgttaaccggggtaaccggtaacgggggtaaacccttaacgggtccccttaccggtaccccgtacggttacccgacgttaccccgaaagggtccccaaccgtccctacgttctccgttaacctttccccg

SEQ ID NO: 433110 - DNA, 699 bp, Homo sapiens
  misc_feature: GZ8MTXP01DV5ZQ.4.57.F02.1.454.CMB.2.raw
  modified_base (309)..(309): a, c, t, g, unknown or other
  modified_base (375)..(375): a, c, t, g, unknown or other
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtcgggtccgccaggctccaggcgaaggggctggaagtgggtgctagttatagttggtttgataggaaactaacaaattctatgcagactcgtagaaggccatcacatcncagagactaattcgaagaacactattagaattctaacagatacgaacagtctagaagaacgaccgngggaccacgggtcttgtacttattagttcgtgacgtagtaaggtaagttggttctaagttcggtttaccttttacgggaccgtagggtcggggaccgaacggggtaaacccggttcggttaccgtaaccgttccgttcccgtaccgtacgtccgttacccgaacccggtaaaccggggtcccctaacggttccccggttcccccgtttcccccgttcggggtccccgttccccgtccggtcccgttacccggacgggaccgttccccgacccggttcgggtaccggggggcccttaaccgggccgggttccccgggtccccggg

SEQ ID NO: 433111 - DNA, 763 bp, Homo sapiens
  misc_feature: GZ8MTXP01CD5H6.4.57.F02.1.454.CMB.2.raw
  modified_base (219)..(219): a, c, t, g, unknown or other
  modified_base (291)..(291): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgccacctcagtgtcagtcgcccaggcagacggcagatactgtgtggaccngcagtcggaaggtaaaagtgacagttggacaggcagaagccaggccaggcccctggtggtggtcgtcgttangatacggcgaccggccctagagggactcccgtgacgcgtatttcccctcgtggcctacccgaacgtcgtaacggggaacccaccgggaccccaaccccgtacgaaccctaacgtccgaacggacccggtaacgggggtaccggaaacggggcccgggggtaagttacggggaaccgggacccggtaacttaacgtttaaccgtagggttaccggaggggtttagggttagggggggtaaacgtttaaggggtaacgggttcgggtaggtaactttaccggaactttaacccgtacgtttaaaccggttaccggtttaaccggggaaaccgggtttaaccgggggaaacccgttaaacggggtttccccgttacccggttacccgttaaccggttcccgttaaaccggacccccgaaagggtacccctaaaccgtccctaacgttccggttaacccttaaccggttttccccg

SEQ ID NO: 433112 - DNA, 661 bp, Homo sapiens
  misc_feature: GZ8MTXP01A7XV2.4.57.F02.1.454.CMB.2.raw
  modified_base (311)..(311): a, c, t, g, unknown or other
  modified_base (615)..(615): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagccgtggggggtccctgagactctcctgtgcagcgtctggattcgccttcagtgcctatggcatgcacgtgggtccgcaggctccgaggcgaagggggctggaagtggggtgctagttatagttggttgataggaaactaaacaaattctatgcagactcgtagaaggccattcacntctacagagactaatttcgaagaacactagttagaaactctaaacagtaactagaaactgtacgtagaaacgacgccgaagggaccacgggtcttgttacttagtttacgttgtagacggagtagttaagtggtactagtttcggttactttgaaccgtagggtcgggacccggaacgggggtaacccgtcggtacctacccggttcctaccgtcgtacgtccttacccgaaccggacggtcccctacggttcccggttcccttccccggtcggcccgtcccgtcgcccgttcgacggtaaccncccgtaaccggttcgggcgggggcccaacggttccgggtccccggg

SEQ ID NO: 433113 - DNA, 693 bp, Homo sapiens
  misc_feature: GZ8MTXP01CZIWY.4.57.F02.1.454.CMB.2.raw
  modified_base (366)..(366): a, c, t, g, unknown or other
  modified_base (683)..(683): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtcgacctcatatgtgctgactcacgcccacctcgagtgtcgagtcggccccagggcagaccggcagactaaccgtgtagtaggaacagcagtacggaaaggtaaagtgtaacgtagttaggtacgaggacaagaacgccgaggcccgacgggtcccctggtcggtcggtcgttcgttatgacgtacggaccggacccggcctacggacgggtacctccgngacggtcgtacgtttcccgcgtacggtacctaccctacgttcggtaacgggaaccgacccgggacccaacccgtacgaaccacgtcgacggacgtacggggtaccggaacgggcgggatacgggaacgccgtacttagtacgtcgacggtagggtggtagggtagtaggtagtaggtacagtacctacgtacctacgttaccggttaccggtaacggaacggtaacggggtaaccttacggggttccttacccggttaaccgtacgttacccgcgttaacccgaacggtaccccaacgtcctaccgttcgtaacccnccgtttcccg

SEQ ID NO: 433114 - DNA, 545 bp, Homo sapiens
  misc_feature: GZ8MTXP01EF60R.4.57.F02.1.454.CMB.2.raw
  modified_base (409)..(409): a, c, t, g, unknown or other
  modified_base (421)..(421): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctggggttttcctcgttgctcttttaagaggtgtccagtgtcaggtgcactggtggagtcgggggagcgtggtccagcctgggggtccctgagctctcctgtgcagcgtctggattcgccttcagtgcctatggcatgcacgtgggtccgccaggctccgaggcaagggggctgggatgggtgcagttatatggtttgataggaactaaacaaattcatgcagtactcgtgaaaggccgattcacatctccaagganactaattcgaanaacatagtagaatctagagatagaatagtcaggagacgacggaggaacgtacggttctgttacttagtttagttggttcgagaaggtaggtaaggtcggtattaggttcggtttccgtttaacg

SEQ ID NO: 433115 - DNA, 673 bp, Homo sapiens
  misc_feature: GZ8MTXP01B2CEE.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtcgacctcatatgtgctgactcagccaccctcagtgtcagtcggcccagggcagacgccaggataactgtgtggaaccagcagtacggaaggtaaaagtgtaacagttggtacgaggcagaacgccaggccacggccctggtggtgtcgtcgtatgatagcgaccggcctcgacgggactcccgtgacgcgtacttctcgtcggcctacctaacgtcgtacggggaaaaccaccgggcccaacccgtcgacccagtcacggacgaacggggtcgaacgggccgggggtatcgggacgggacccgtaattaacgttcgtcgggtacgaggggttggtaggggaagttagggggttagggttagggttgaacttacgactccgtaagttaccggttacgttaccggggtaacgtcgggaacccgtaacgggttccttacccgggttccttacgtccgaaccggttaccccgaacgggaccccctaaccctaccggttccgtacctcccttccgttcccggttccccgtccccc

SEQ ID NO: 433116 - DNA, 658 bp, Homo sapiens
  misc_feature: GZ8MTXP01A7E92.4.57.F02.1.454.CMB.2.raw
  modified_base (225)..(225): a, c, t, g, unknown or other
  modified_base (298)..(298): a, c, t, g, unknown or other
  modified_base (387)..(387): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgcaggataactgtgtggaaccngcagtcggaaggtaaagtgtacattggtacaggcagaagccaggccaggcccctggtggtcggtcgtccgtangatacgcgaccggccctcgagggtactcccgtgacgcgtattcctacgtggcctaccaacgtcgtacgggaaccaccgggcccaacccncgaaccagtacgaggccgaggggtaccggaaacgggcccgggggaatcgggaaccgggccgtaacttaacggtttaccgtgggtaccgtaaggggttcgggtaggggggtaagttacggggtaggtggtagaacgtcgtaactccgtaacgttaccgtaccgttacggggaacgttcgggggaacccgttacgggttcccttccggttcccgtaccggttcgacgaccccgaaggccctaacctccgtacttcgtaaccttaacgttcccg

SEQ ID NO: 433117 - DNA, 686 bp, Homo sapiens
  misc_feature: GZ8MTXP01BL600.4.57.F02.1.454.CMB.2.raw
  modified_base (297)..(297): a, c, t, g, unknown or other
  modified_base (362)..(362): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccaggcagacggcaggataacctgtgtaggaaccagcagtacggaaggtaaaagtgtacagttggtacaggcagaagccaggccaggcccctgtggtgtcgtccgttangatagcgaccggccctgagggactccctgagcgattctctcggcctaccaactcgtgggaaaccnccgggcccaccctgacccatccgagtcgacggggtacgaaggccggggtatcggacggcccgtaacttagttaccgtgtacgagggttgtaggggaattaggggtaaggttgggtagtactcagttcccaagttaccggttccgttacgggaaaccgttcgggggaaacccctaaacggggttcccttacccggttaccccgtttaccggtaccgaacccggacccccgaaaacggggttacccccccaaaaacccccggtacctttccggttacccaaccctttcccggttaaccccgtttttccccccccgtaacccccccg

SEQ ID NO: 433118 - DNA, 591 bp, Homo sapiens
  misc_feature: GZ8MTXP01B6CMA.4.57.F02.1.454.CMB.2.raw
  modified_base (205)..(205): a, c, t, g, unknown or other
  modified_base (425)..(425): a, c, t, g, unknown or other
  modified_base (456)..(456): a, c, t, g, unknown or other
  modified_base (464)..(464): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtcggcccaggcagacgcaggatacngtgaggaaccagcagtcggaagtaaagtgtaacagtggtacaggcaagaagccgaggccacggccctggtggtggtcgtcgtatgataggccgacccggcctagagggtactcccgtgacgcgtattcgtcgtcggcctacaactcgtacgggaaaccaccggcccacccgtgacccatcgagcgagggtcaaggccgggatggacgccgactagttacngtcgaggtgtagggataggggtaggtggtanactacganacctagtacgttcgtagggtaaccgtacgggaaccgtaacggtccgttaccggtccttacgtacacggttaccccgaaggaccccaaccccgtatcgtccctacgttcctcccggttccccgtcccc

SEQ ID NO: 433119 - DNA, 759 bp, Homo sapiens
  misc_feature: GZ8MTXP01C9DAQ.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagtcttgggttttcctcgttgcttcttttaagaggtgtccagtgtcaggtgcaccgtgggtgggaggtcggggggagcgtggtccgaggccggtgggggtccctgagtactctccgtgtgcagcgtcgtggacttcgccttcagtcgcctagtcggctagtcgccgtacgtcggggtccccgccgacgggcctaccgaagggcggaagggggtcgtagggaagttggggtagacgtagtttatacgttggtttagagtaacggaaactaaaactaaattcgtatcgacacgtaccgtcggtagggaacggtcctattccaacctagtacctaccgaaagtaactaacttaaacgttacgaaacgtaaactaactaagtttaaggaaacttccgtaaaagaacggtaagttaacgaaaccgttaggttaaccgtaaggggtaaacgaacccgggaacccgggtaaacgggaacccgtaacggggttcccttttaagggttccttttaaaagggttttcgttagggttcggttaaacggttaaagggtaaaaggttaacgggttacgggttacgttaacggttttccgggtttaaccggttttaaccgggg

SEQ ID NO: 433120 - DNA, 636 bp, Homo sapiens
  misc_feature: GZ8MTXP01CM973.4.57.F02.1.454.CMB.2.raw
  modified_base (362)..(362): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtcggccccagggcagacggccaggataacctgtgtgggaaccagcatcgggaaggtaaaagtgtacattggacaggcagaagccaggccaggcccctggtggtggtcgtccgtatgatacgcgaccggccctgaggactcccgtgagcgattctcgtcggcctcaacgtcgtaggaaaaccncggcccaccctgaaccactcacgcgacggggtacgaaggccggggatggacggaccgaacgttacttacgtggtcgagggtggtaggggtataggggttaaggtcgggtagtacgtactaagtacccgtagttaaccggtacttccgggaaaccgttcggggaacccgtaaacgggttcccttccgggttaccccttacggttaccgacgaccccgaaacggaccccctaaaccccacttcgtcccaccttccgtccgttaaccccctaacccc

SEQ ID NO: 433121 - DNA, 541 bp, Homo sapiens
  misc_feature: GZ8MTXP01BUALU.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaactaacaaattctatgcagactccgtgaagggccgattcaccatctccagagacaatttcgagaacacattgaatctacagatgaacagtctgaagacgcgagacacggctgtctattatgtgcgagagtaagtgtcagtgtctttgacgagtgggccagggggaccctggtccaccgtctccgtcacgcttcccaccgaacgggcccactccggtccttccccgcggccgccctcgccttccgacggcgccaaccgtcgcgggggccaacgcggcccggg

SEQ ID NO: 433122 - DNA, 580 bp, Homo sapiens
  misc_feature: GZ8MTXP01BVE2A.4.57.F02.1.454.CMB.2.raw
  modified_base (470)..(470): a, c, t, g, unknown or other
  modified_base (572)..(572): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggccaggataacctgtgtaggaaccagcagtcggaaggtaaagtgtacattggtacaggcagaagccaggccaggcccctggtggtggtcgtccgttatgatagcgacccggcctcgagggactcccgtgagcgtattccctctggctaccaactcgtacgggaaccacggcccaccctcgaccatcagcgagggtcgaaggccggggatggacggccgtactattacgtgtacgagggttggtagggggtagtaggtaggtggtnacgtcgatacctattccgtcgttacggaacgtcggggaaccagggtcccttccgtacctacgttccgacgacccgaaggcccaacgtccacgttcgtaaccncgttcccg

SEQ ID NO: 433123 - DNA, 741 bp, Homo sapiens
  misc_feature: GZ8MTXP01BRK5X.4.57.F02.1.454.CMB.2.raw
  modified_base (213)..(213): a, c, t, g, unknown or other
tcagagcactgtagcacgaccggtgctcgatttagctcgatatagttggggtttggggggaagaggaagactgacggtcctcccaggtgtccagtgtcaggtgcacctggtggaggtcggggggaggcgtggtccagccgtggggggtccctgagactctcctgtgcagcgtctggattcgccttcagtgcctatggcatgcacgtgggtccnccaggctccgaggcgaagggggctaggaagtggggtgctagttatagttggtttgataggaaactaacaaattctatgcagactcgtagaaggccatcacatctaccagagacaatttcgaagaacactattagaaatctaacagaatagaaactagtctagaaagacgccggaaggaaccgacgggtcttagtactaatttagttgtgacggtaagagtaaaggttggtactagttacggttccgttttacggaacccgtagggttacggggaccccggtaaacggggggggtaaaccccgttcggggttaccccgaaccccggtttccgtaccccgttaccgtaccggttacccctttaccccgaaaccccggtaaaccggggtccccctaaacggttccccgggttcccctttccccccggtcggttccccgtccccgttcggttaccccgttcccggaacgggaaccgtacccgtaacccggtttccgggacggggggaccctaaccggccgggtcccccgggg

SEQ ID NO: 433124 - DNA, 728 bp, Homo sapiens
  misc_feature: GZ8MTXP01B6YLI.4.57.F02.1.454.CMB.2.raw
  modified_base (174)..(174): a, c, t, g, unknown or other
  modified_base (217)..(217): a, c, t, g, unknown or other
  modified_base (273)..(273): a, c, t, g, unknown or other
  modified_base (286)..(286): a, c, t, g, unknown or other
  modified_base (358)..(358): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgccaccctnagtgtcaggtcggcccaggcagacgcagatactgtgaggaacngcagtcggaagtaaagtgtactagttggacaggcagaacgcaggccaggccctggnggtggtctcgtangatacgcgaccggcctgacggactcccgtaggagcgtattctcgtcggcctacgaacttcgacgggaaaccnccgcccacctcgaccatcgaggcgtacggggacgaagggccgggatgggacggaccgtaattacgttacgtggtacgagggttggtagggtaatttaggggggtaaggtttggggtactaacggttacaacgtttacccgtaagtttacccgggttaccgttaaaccgggggtaacgttacccgggggtaaacccgtaaacccggggtttcccgttaccccgggtttaccccttaaccgggttaaccctaaccccgggttaaacccccgaaaacccggggacccccctaaaaacccccggtccgttaaccggtttaacccctaccccgtttcccggttaacccccgggttttcccccccgtttaaccccc

SEQ ID NO: 433125 - DNA, 571 bp, Homo sapiens
  misc_feature: GZ8MTXP01EVDP9.4.57.F02.1.454.CMB.2.raw
  modified_base (213)..(213): a, c, t, g, unknown or other
  modified_base (218)..(218): a, c, t, g, unknown or other
  modified_base (270)..(270): a, c, t, g, unknown or other
  modified_base (356)..(356): a, c, t, g, unknown or other
  modified_base (413)..(413): a, c, t, g, unknown or other
tcagagcactgtagcacgaccggtgctcgatttagctcgatatagttgggttggggctgggcctaaggaagcagcactggtggtgcctcagccatggcctggaccgttctcctcctcggcctcctctctcactgcacaggctctgtgacctcatatgtgctgactcagccaccctcagtgtcagtcgccccaggcagacgcaggatactgtgnggacngcatcggaagtaaatgacattggtacaggcagaagccaggccaggcccctgnggtggcgtccgtatgatagcgaccggccctcgagggactcccgtgagccgattccctcgtggcctacccaactccgtagggaaccncgggcccaccctgacccatcagcagggtcaaggccgggatgacggcctatattacgngtacagggtgtagggggattaggtagtcgtgactgatccctagttaccgtcgttacggaacgtcggggaaccttaagggtcccttaccggtccctacgttaccgcgaccccgaagggcccctaaaccgttcccaacgttcgtccttaaccgtttcccg

SEQ ID NO: 433126 - DNA, 666 bp, Homo sapiens
  misc_feature: GZ8MTXP01DJLYG.4.57.F02.1.454.CMB.2.raw
tcagagcactgtagcacgaccggtgctcgatttagctcgatatagttggggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcacgtgggtccgccaggcctccgaggcaagggggctaggaagtggggtgctaagttatagttggtttagataggaaactaaacaaattctaatgacagactcgtaggaacggcctatcaccatctccagagaactaattcgaagaacactattagaaatctaacagtatagaaactagtctaggaaagacggccggaaaggaaccaacgggtctagttacttaatttaattggtgacggaagtaagtaaggttggtactaagttcggttccgttttagaaccgtagggtacggggacccgaaacggggggtaaccccttgggtacctaccggtcctacctcgacgtacctacccaccgtaaacggccccagttccggttccccttccccgtcggccccgtcccgtcttcccgttccgacgggtcgacccgtcccgtcggtcgggggacctaacggaacggtcccggg

SEQ ID NO: 433127 - DNA, 679 bp, Homo sapiens
  misc_feature: GZ8MTXP01BDH68.4.57.F02.1.454.CMB.2.raw
  modified_base (226)..(226): a, c, t, g, unknown or other
  modified_base (228)..(228): a, c, t, g, unknown or other
  modified_base (303)..(303): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggcaggactacgtgtgaggacngnagtcggaaggtaaagtgtactagttggacaggcagaagccgaggccgacggccctggtggtggtcgtaccgttanggatacggccgacccggcctacggagggactcccgtggacgcgtattcccgcgtcggtcctaccgaaccgtcgtaacgggaaccaccgggcccaacccgtcgaacctactcgacggcgacggggtacgggaacgggccggggaagtcgggacgggtacctaacgttacgtacgtggtacggtaggggttcggtaggggggtaattaggggttaggtgggttagtatccgtaatacccgtagttacccggttacgtaccgggaacgtcggggtaaaccgttacgggtaccttccccgggaacttccggaccgccgttaaccccggaacggtaccccaaaccgtcccgtaacgttaccgtaaccttaaccgttccccg

SEQ ID NO: 433128 - DNA, 679 bp, Homo sapiens
  misc_feature: GZ8MTXP01CAJRM.4.57.F02.1.454.CMB.2.raw
  modified_base (173)..(173): a, c, t, g, unknown or other
  modified_base (221)..(221): a, c, t, g, unknown or other
  modified_base (291)..(291): a, c, t, g, unknown or other
  modified_base (317)..(317): a, c, t, g, unknown or other
  modified_base (639)..(639): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcaggtcgcccgaggcagacggcaggataacgtgtgtaggaacngcagtacggaagtaaagtgtacagttggacaggcagacgcaggccacggcctggtcggtggtcgtcgtangagtcgcgaccgcctgaggactccgngacgcgtattcgcgtcgcctacgaacgtccggtacgggaaaccacccggccctaacccgtacgaaacccacgtacgaacgggtaccgggacgggggtaccgaacggggacccggggatacgggacggaccgtaatttaacgtgtacggtaggtagggtgtaggggtaagttagggggttaggttaggtagtacctacgtacgttaccccgtaaggtttacccggttacggttaaccggaacgggtaccgggtaacccgtaacgggttccgttacccgtaccgttacgaaccgaccgttaccccgaacggccccctaaacccncgttaacgccctacgttcccgttccgttcccccgtaaccc

SEQ ID NO: 433129 - DNA, 670 bp, Homo sapiens
  misc_feature: GZ8MTXP01BKG20.4.57.F02.1.454.CMB.2.raw
  modified_base (311)..(311): a, c, t, g, unknown or other
  modified_base (348)..(348): a, c, t, g, unknown or other
  modified_base (534)..(534): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctcagtgtcagtcggcccaggcagacggcaggataactgtgtaggaaccagcagtcgggaaggtaaaagtgtactagttggacaggacaaggaacgccgaggcccgacggtcccctaggtggtcggtcgtccgttangactaggccgaccggcctgagggtactcccgtggacncgtacttccgtcgtcggtcctacccgaacgttcgaacgggaaccaccgggcccaccccgtagaaccccagtaccgagggaccggtagggaccggaaacggggccgggggaattacgggaaccggacgtaacttagtaaccgttggcgtaagggttgaggggggtattaaggggtagtggggttaanacgtcgtaacgttacctacgttaccggttacgtaaccgggaagtaacgggtaaccttacggttcccttacggtaccgtacgaccgacggaccccgtaaggcccctaacgtcctacgttctaaccgttaacccgtcg

SEQ ID NO: 433130 - DNA, 559 bp, Homo sapiens
  misc_feature: GZ8MTXP01AGYNJ.4.57.F02.1.454.CMB.2.raw
  modified_base (224)..(224): a, c, t, g, unknown or other
  modified_base (403)..(403): a, c, t, g, unknown or other
  modified_base (431)..(431): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacgcaggatacctgtgtggaaccngcatcggaaggtaaagtgtacattggtacaggcagaagccaggccaggcccctggtggtgtcgtcgtatgatagcgaccggcctcgagggactccctgagcgacttcctctggcctccaactcgtagggaacaccgggcccaccctgacccatccagcgagggtacgaaggccggggancggacggccgactatactgtcagggtgngggggataggtagtggtgatgactccaactcgtacgttcggaacgtcgggaaccgaaggtccttcccgtccgtaccgttacgccgacccgaaccggaccaacctaccacttcgtaaccaactttcccg

SEQ ID NO: 433131 - DNA, 662 bp, Homo sapiens
  misc_feature: GZ8MTXP01DKYCD.4.57.F02.1.454.CMB.2.raw
  modified_base (149)..(149): a, c, t, g, unknown or other
  modified_base (227)..(227): a, c, t, g, unknown or other
  modified_base (271)..(271): a, c, t, g, unknown or other
  modified_base (278)..(278): a, c, t, g, unknown or other
  modified_base (283)..(283): a, c, t, g, unknown or other
  modified_base (291)..(292): a, c, t, g, unknown or other
  modified_base (306)..(306): a, c, t, g, unknown or other
  modified_base (314)..(314): a, c, t, g, unknown or other
  modified_base (316)..(316): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcagcccaccctcagtgtcaggtcggccccgaggggcaggacggccaggataactgtgtggaaccngcagtcggaaggtaaagtgtacattggtacaggcagagcaggcngccctgnggtgngtcgtatnnagcgaccgcctcgnggactccngngcgtactctctcgctcactcgtcggaaacacgcccacccacgaccactcgacgtacgacggggtacgaacggccgggggagtacgggacgggaccggaacgttacttaaacgttcggtacgtagggtggttaaggggtagttagggggtaaggttggggttagacgtacgtactaccgtagttaaccgttcgtttaccgggaaacgtcggggtaaccgtaaacggttcgttacccgttcccgttaaccgttccgacggaaaccccgaccgggttaaccccaacccccgtacccgtcggttacccgacccgttaccctttccccgttaaccccgtttaacccccccg

SEQ ID NO: 433132 - DNA, 597 bp, Homo sapiens
  misc_feature: GZ8MTXP01A1WOD.4.57.F02.1.454.CMB.2.raw
  modified_base (210)..(210): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtctctgagactctcctgtgcagcgtctggattcgccttcagtgcctatggcatgcactggggtccnccaggctccaggcaaggggctggaatggggtggctagttatatggtttgatggaactaacaaattctatgcagactcgtagaaggccattcacatctcagagacattcgaagaacacattagaatctacagatagaacagtcaagagaacgccgaggacacggctgtacctattattgtagacgagaagtaagtggtactagtcggttcctttagaccgagggtcgggaccggaacggggtaacccgtcggtaccaccgtcctccgtcacgtcctacccgaccgaacgggccctaagttccggttcccttccccgttcggcccgtccccgttacgcccttacccgaaggaccgtccgtacccgtcggttcgggggccaacggccggg

SEQ ID NO: 433133 - DNA, 702 bp, Homo sapiens
  misc_feature: GZ8MTXP01EWIFP.4.57.F02.1.454.CMB.2.raw
  modified_base (631)..(631): a, c, t, g, unknown or other
tcagagcactgtagcacgaccggtgctcgatttagctcgatatagttggggtttggggggaagaggaagactgacggtcctcccaggagttcaggtgctgggcaccgtgggcagtggggggaggcgtggtccagccgtggggggtccctgagactctcctgtgcagcgtctggattcgccttcagtgcctatggcatgcacgtcgggtccgccaggcctccgagggcgaagggggctaggaagtggggtgctagttatagttggtttgagtaggaaactaataaattcatgacagactcgtagaacggcctatcacatccacagagactaattacgaagaacactagttagaacttctaaacgagtataacgaaactagtacgaggaacggaacggaccggaagggaaccgacgggtccttagttactttaatttagttgacgacggtaaggtaaaggttaagtcggttcttaaggttccggtttttaccgttacggaaccgtaggggttaccggggaaccgtaaccggggtaacccgttgggtacccgtacccgttcctacccgtcgaccgttcccgttacccgaaaccggtacgggccccttaacggttcccggtcccctttccccggnggccccttccgtcgacccgttacgacggctcccgtaccgttcgggcgggcaccggccgggcccggtcccgg

SEQ ID NO: 433134 - DNA, 593 bp, Homo sapiens
  misc_feature: GZ8MTXP01EQ6DZ.4.57.F02.1.454.CMB.2.raw
  modified_base (216)..(216): a, c, t, g, unknown or other
  modified_base (221)..(221): a, c, t, g, unknown or other
  modified_base (287)..(287): a, c, t, g, unknown or other
  modified_base (327)..(327): a, c, t, g, unknown or other
  modified_base (357)..(357): a, c, t, g, unknown or other
  modified_base (431)..(431): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagcgcagatacctgtgnggacngcagtcggagtaaatgacattggacaggcagaagccaggccaggcccctgtggtggtcgtccgtangatagcgaccggccctcgagggactccctgagcgattccncgtggctacccaacgtccgtacgggaaccnccgggacccaccccgtcgaccctagtcgacgcgagggtacggaaggccggggatcggacggccgtatattacgngtcgagggtggtagggggtattagggtagtggtgatctagtccctagttccgtcgttaccgggaacgtcgggtaacccaaggttcccttcccggtacctacggttccgacgaccccgaacggaccctaaccttccgaccttcggtcccttaaccgttccccg

SEQ ID NO: 433135 - DNA, 774 bp, Homo sapiens
  misc_feature: GZ8MTXP01BHSAQ.4.57.F02.1.454.CMB.2.raw
  modified_base (229)..(229): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccaccctcagtgtcaggtcggccccgagggcaggacggccaggataaccgtgtgtggaaccngcagtacggaaggtaaagtgtacagttggtacaggcagaacgccgaggccacggcccctggtggtggtcgtccgttatgagtacgccggacccggcctcgaggggactcccgtgagcgtattcgtctcggcctaccgaactcgagggaaacccaccggcccacccgtcgaaccctacgtaccgaacggcgtaacgggggtaccgaaacggggcccgggggagtcggggaaccggacccggtaaacgtttaagtttacgtacggttcggaaggggttggttaacgggggtaagtttaggggggttaagggtttcgggtaaggacgttaccaaacgttcccgtaacggtttaccggttacccggtttaccggggaaaccgggttcggggaaaccccgtaaacggggtttcccgttaccccgggttacccgttaaccggttaccgaacccgggttacccccgaaaaccggggttacccccctaaaaccccccgtagttcccggtacccaccgttttccccggtccccgtttcccccccgttaaccccc

SEQ ID NO: 433136 - DNA, 640 bp, Homo sapiens
  misc_feature: GZ8MTXP01CQGRL.4.57.F02.1.454.CMB.2.raw
  modified_base (217)..(217): a, c, t, g, unknown or other
  modified_base (295)..(295): a, c, t, g, unknown or other
  modified_base (309)..(309): a, c, t, g, unknown or other
  modified_base (334)..(334): a, c, t, g, unknown or other
  modified_base (449)..(449): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccaccctcagtgtcaggtcggcccgagggcaggacggcaggatactgtgnggaacagcagtcggaagtaaagtgtacagttggtacaggcagaagccgaggccacggccctggtggtggtcgtcgtangatgcgaccggccncgagggactcccgtgagcgtattcncgtcggcctaccaacgtcgtacgggaaaaccaccgggcccaccctagggacccacgtcgacggcgaagggggtcgaaacgggccggggtatgggacggccgtaacttacttacgnggtacgtagggtggtagggtagttaggggtaggtgggtagacttcgacgtccgaagttaccggtcgttacgggaacggtcgggaacctaacgggttccttacccggttaccttacggtaccgacgaccccgttaacggaccccaaaccccgtcgtcgtccaccgttcctaacccgttcccccgtaaccccg

SEQ ID NO: 433137 - DNA, 606 bp, Homo sapiens
  misc_feature: GZ8MTXP01BZBQI.4.57.F02.1.454.CMB.2.raw
  modified_base (557)..(557): a, c, t, g, unknown or other
  modified_base (578)..(578): a, c, t, g, unknown or other
tcagagcactgtagcacgaccggtgctcgatttagctcgatatagttggggtttggggggaagaggaagactgacggtcctcccaggagttcaggtgctgggcaccgtgggcatggggggaggcgtggtccaggccgtggggggtccctgagactctcctgtgcagcgtctggattcgccttcagtgcctatggcatgcacgtgggtccgccaggcctccgaggcgaaggggctagggaagtggggtgctagttatagttgggtttagataggaaactaactaaattctaatgacagacgtccggtaggaacgggccattccactatcctaccaagagactaagtttacgaacgtaacactattagaacttactaacagtaactacgaactagtctaggacgaacgaccggaaggactaacgggtctacggtacttagttagtgtagacgtaagtaggtagtcgtatagttcgttcttgacgtgggtcgggacgtacgggaccgtgtccacgtctcctcgcgtcctaccgacgtaccggcctcgtccgtcctcccgngcccgccgtcgccttcgagcnctccgtcggcgggcacgcgccggtccgg

SEQ ID NO: 433138 - DNA, 821 bp, Homo sapiens
  misc_feature: GZ8MTXP01AC1K5.4.57.F02.1.454.CMB.2.raw
  modified_base (215)..(215): a, c, t, g, unknown or other
  modified_base (222)..(222): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacgcaggatactgtgnggaaccngcatcgggagtaaagtgtacagttggacaggacagaagccaggtccacggcccctggtggtggtccgtcgttatgagtacggcgtacccggcctcgagggtactcccgtggacgtcgtactttcccgtcgtcggacccttacccgaaaccttcgggtacgggggaaaccccgacccgggacccctacccgtacgaacccgtacgtaccggtaacgggaccgggtaacgggggtaacccgggaaccgggggtaccgggggtaaggtaccggggtaacccgggtaacccggttaaacgttttaaacggttaccggttacgggttaacgggtaacgggggtttaggggtaacgggggggtttaaaggtttaagggggttacgggttacggggttacgtaacgttaccgtaaaccgtttaccggttaaacggtttacccggtttaccgggttaaccgggtaaccgggtaaccggggtaaacccgttaaccgggttccccgttacccggttacccgtaaccggttcccgaacccggaccccgtaaaccggtacccctaaacccgtcccgtaccgttccgttaacccgttaacccgttaaccccg

SEQ ID NO: 433139 - DNA, 683 bp, Homo sapiens
  misc_feature: GZ8MTXP01EOUH1.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtcgggtccgccaggcctaccgaggcgaaggggctaggaagtggggtgactagttatagttggtttagagtaggaaactaactaaattctatgcagacgtcggtaggaacggcctattccacctatcctacaagagtaactaagtttacgaaacgtaacactaattagaaactactaacagaatacgaactagtacgagacggaaacgccgaacggacacgggtcttaggtacttagttagtggagacgtaagtaggtagtgtactaggttcgtttaccttagaaccgtgggtcgggaccgaacgggtaccgtcggtacctaccgtctaccgtcgtacgtacccgttacccgaaccggtccggtacccctacggttccccggttcccctttccccggcgggtccccttcccgtcggcccgttaccggcggttacccgtcccggtacgtccgggcggggaccaccggtccgggcccggtcccggg

SEQ ID NO: 433140 - DNA, 723 bp, Homo sapiens
  misc_feature: GZ8MTXP01A3XLR.4.57.F02.1.454.CMB.2.raw
  modified_base (217)..(217): a, c, t, g, unknown or other
  modified_base (224)..(224): a, c, t, g, unknown or other
  modified_base (296)..(296): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggatactgtgnggaaccngcatcggaaggtaaagtgtacattggtacaggcagaagccaggccaggcccctggtggtggtcgtccgttangatagcgaccggccctcgacggggactcccgtgacgcgtacttcccgtcgtggcctcccgaactcgtacggggaaccaccgggcccacccgtcgaacccatcgagcgaggggtacgaacgggcccgggggatcgggacggacccgtaacttacgttaaccgtggtacgtaaggggttggtaggggggtaagttaaggggttaggttacgggtaaaacttccgaacttacccgtaaagttacccgttaccgtttaccggggaaacgttcgggggaaaccccgttaaacggggttcccgttaccccgggttacccgttaaacccgggttacccgaacccgggttacccccgaaaaccgggggtcccctaaaacccggttccccgtaaaccgttccggttaccctaacccgtttcccgtttccccccggg

SEQ ID NO: 433141 - DNA, 606 bp, Homo sapiens
  misc_feature: GZ8MTXP01B17SP.4.57.F02.1.454.CMB.2.raw
  modified_base (153)..(153): a, c, t, g, unknown or other
  modified_base (179)..(179): a, c, t, g, unknown or other
  modified_base (230)..(230): a, c, t, g, unknown or other
  modified_base (448)..(448): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcacgcccaccctnagtgtcagtcggccccagggcaggacgcaggactaacgtgtgtaggaaccngcagtacggaagtaaagtgtacagttggtaacaggcaagaacgccaggccaggcccctagtggtggtcgtcgtactagatacgcgaccgccgtcgaggactcctgacgcgtacttcctctggctacccaacctacgtacgggaaccgacgcccacccgtacgaccgactcgacgacgtaggacggaaaggccgggagtgaacggcgactatacgtcgngtaagtggaggggtagttaggtaagtcggtagatcagtacctagttacgtcgttaccggacgtaacgggaccgttaacggtccttccgtacccgtacgttaccgaccggacccaaccgggacctaacccttcgaccttcgtcccttaacgtttccccg

SEQ ID NO: 433142 - DNA, 636 bp, Homo sapiens
  misc_feature: GZ8MTXP01BAL6W.4.57.F02.1.454.CMB.2.raw
  modified_base (224)..(224): a, c, t, g, unknown or other
  modified_base (304)..(304): a, c, t, g, unknown or other
  modified_base (333)..(333): a, c, t, g, unknown or other
  modified_base (515)..(515): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggactactgtgtaggaaccngcagtacgggaaggtaaaagtgtactagttggtacaggcagaacgccgaggccacggccctggtggtcggtcgtcgttangagtagccgaccggcctcgaggactccgngacgcgtatctcgtcggcctacaacgtcgtacgggaaacccaccggcccacccgtacgaccagtcgacggacggtacggggtacgaaacggggccggggtaagtcgggacggtacccgtaacgttacgttaaccgtggtacggtagggttggtaggggtaattagggggtaggtggggttanacgtcacgtcctaagttaccgtcgttacggaacgtcgggactaacggtccttccgtcgttacgacgaccgacccgacgcccctaaccgtactcgtaccacgttccttccgttccccgtccc

SEQ ID NO: 433143 - DNA, 550 bp, Homo sapiens
  misc_feature: GZ8MTXP01APAB7.4.57.F02.1.454.CMB.2.raw
  modified_base (298)..(298): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcgggaaggtaaaagtgtacattggtacaggcagaagccaggccaggcccctggtggtggtcgtccgttangatagcgaccggccctcgagggactcccgtgagcgattctctcggcctccaactcgtagggaaaccaccgggcccaaacctgaccatcgagcgagggtcgaaaggccggggatggaggccgactattactgtcagggtgagggtatagggtagtggtgattcatccatacgtcttcggactcgggaccaaggtcttccgtcttcgtcacgcccgaacggcccaacccgctcgcacttctcgttcccccgccc

SEQ ID NO: 433144 - DNA, 619 bp, Homo sapiens
  misc_feature: GZ8MTXP01ALLHD.4.57.F02.1.454.CMB.2.raw
  modified_base (204)..(204): a, c, t, g, unknown or other
  modified_base (251)..(251): a, c, t, g, unknown or other
  modified_base (332)..(332): a, c, t, g, unknown or other
  modified_base (341)..(341): a, c, t, g, unknown or other
  modified_base (346)..(346): a, c, t, g, unknown or other
  modified_base (548)..(548): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactggtccnccaggctccaggcaaggggctggaatgggtggcagttatatggtttnataggaactaaacaaattctatgcagactcgtgaaggccatcaccatctccagagacattcgagacacattagaatctaanagatcgaanagtcngagaacgccgaagacacgggtctagttcttaattattggtacgagtaaggtaagtaagtggtctaagttcggttacgtttacgacgtaaggtcgggaccgtaacgggtaccggtgtccgtaccgtcctcttcgcgtccttacccgaaccggtaacgggtcccctaacggttcccgttaaccccgtccccgttcgggtccccncccgttcgcccgttccgacgggccgtcccgtacggttcgggacgggggccaccgggtcggcccggtcccgg

SEQ ID NO: 433145 - DNA, 639 bp, Homo sapiens
  misc_feature: GZ8MTXP01B4PRO.4.57.F02.1.454.CMB.2.raw
  modified_base (208)..(208): a, c, t, g, unknown or other
  modified_base (283)..(283): a, c, t, g, unknown or other
  modified_base (323)..(323): a, c, t, g, unknown or other
  modified_base (397)..(397): a, c, t, g, unknown or other
  modified_base (415)..(415): a, c, t, g, unknown or other
  modified_base (432)..(432): a, c, t, g, unknown or other
tcagagcactgtagcacgaccggtgctcgattagctcgatatagttgggtttggggggaagaggaagactgacggtcctcccaggagttcaggtgctgggcaccgtgggcagtggggggaggcgtggtccagccgtggggggtccctgagactctcctgtgcagcgtctggattcgccttcagtgcctatggcatgcacgtgggtccnccaggcctccgagggcgaaggggctagggaagttggggtggctagttatagttggtttagagtaggaaactaaanaaattctatgcagactcgtgaaggcatcacatctacaganactaacttagaacgaacactattagaatctaacgagatacgaactagtcgtagagaacgccggaaggacacggnttgtacttagtttattgngacgagtagtaggtgtntagttcggttctttacgcgtaggtcggggacgtacgggtaccgttcggtaccgtacccgttcgtcctccgtacgccgttacccgacccgtaacggcccgtagttccccggtcccttccccgcgggccccttcccgtacgcccgttaccgcgggaccgtcccgtacccgttcggggccgggaccgaccggccggggcccggtcccggg

SEQ ID NO: 433146 - DNA, 600 bp, Homo sapiens
  misc_feature: GZ8MTXP01D33PF.4.57.F02.1.454.CMB.2.raw
  modified_base (212)..(212): a, c, t, g, unknown or other
  modified_base (244)..(244): a, c, t, g, unknown or other
  modified_base (316)..(316): a, c, t, g, unknown or other
tcagagcactgtagcacgaccggtgctcgatttagctcgatatagttgggtttggggggaagaggaagactgacggtcctcccaggtgtccagtgtcaggtgcacctggtggaggtcggggggaggcgtggtccagccgtggggggtccctgagactctcctgtgcagcgtctggattcgccttcagtgcctatggcatgcacgtgggtccncaggctccgaggcaaggggctggaatgggtgntagttatagtggttgataggaactaacaaattctatgacagactcgtagaagggccattcaccatctcaganaactaattcgaagaacatattagaactctacagtatgaaacagtctagaaagacgtccgaaggacacgggtctgttactattatgtgcgagagtagtgtactattgtcgtttgaccgtggtacggggaccgaacgggggtaaccctggtaccgtaccgttctcccgtcgacgtaccttccgaacccgtaaacgggcccctaagttccggtcccttccccgtcggttccgccccgtgccgttccgacggaaccgctccgtacggcggggactaacgcggtcccgg

SEQ ID NO: 433147 - DNA, 660 bp, Homo sapiens
  misc_feature: GZ8MTXP01CBZRR.4.57.F02.1.454.CMB.2.raw
  modified_base (305)..(305): a, c, t, g, unknown or other
  modified_base (524)..(524): a, c, t, g, unknown or other
  modified_base (602)..(602): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctctttaagaggtgtccagtgtcaggtgcacctggtggagtcgggggagcgtggtcagccgtgggggtcctgagctctcctgtgcagtcgtctggattcgccttcagtcgcctagtggcatgcacgtcgggtcccnccgaggcctaccgagggaccgaagggggcttagggaagtgggggtgacgtagttattacgttggtttagagtacggaaacttaaaaacgtaaatttcgtaagtcgactaacgaccgttaccgggtaggaaacggggtaccctattaccgaaccctatcccgtaccgaagtaacgtaactaagttaccgaaagtaaacactaattacggaattccgtaanaaggactagaaacgtagtactacggaaggaccgaccgaagggaaccgtaacgggccttaggttacttaagttgttggnggttacggtaaggtaaggtaacggttggtccttaaggttccggtttccgtttaacggg

SEQ ID NO: 433148 - DNA, 572 bp, Homo sapiens
  misc_feature: GZ8MTXP01DRHIQ.4.57.F02.1.454.CMB.2.raw
  modified_base (225)..(225): a, c, t, g, unknown or other
  modified_base (547)..(547): a, c, t, g, unknown or other
tcagagcactgtagcacgaccggtgctcgatttagctcgatatagttgggtttggggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataactgtgtgggaaccngcagtcgggaaggtaaaagtgtacattggtacaggcagaagccaggccaggccctgtggtggtcgtcgttatgatagcgaccggccctgagggatcccgtgagcgattctcgtcggctacaactctagggaaaccacggcccaccctgaccatcagcgagggtcgaaggccgggggatggacggccgtaactattacgtgtcgagggtggtaggggattaggggtaggttggtgatacgatcccaagttaccgtcgttacggaacgtgggaaccctaagggtccttccgtccttacgtcacgaccccgaggccccaaccccntcgtcacttctcgttccccgtcccc

SEQ ID NO: 433149 - DNA, 665 bp, Homo sapiens
  misc_feature: GZ8MTXP01DB835.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggccaggataacctgtgtgggaaccagcagtcgggaaggtaaaagtgtaactagttggtacaggcaagaagccaggccacggcccctggtggtggtcgtcgttatgatagccgaccggcctcgaggactcccgtgacgcgtattctcgtcggcctaccaacgtccgtacgggaaaacccaccgggcccacccgtgaacccatccgagcgaacggggtcgaaagggtccgggggatacgggacggtacccgaacttacgttaacgtgtacgtagggtggtagggattaggggtaggtgggttagagtactacgtcccgtaagttaccggttcgtttaaccggggaacgtacggggaaccctaaagggttcccgttacccggttccgttaccgtccgaacggaccccgacgggttaccccaaccccgtactccgttaccaccgttccctccgttcccccgtaacccc

SEQ ID NO: 433150 - DNA, 664 bp, Homo sapiens
  misc_feature: GZ8MTXP01CPYF4.4.57.F02.1.454.CMB.2.raw
  modified_base (227)..(227): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcaggacggccaggactaactgtgtcggaaccngcagtcgggaaggtaaagtgtacagttggacaggcaagaacgccgaggccacggccctggtcggtcggtcgttccgttatcggaagtcggccggaccccggccctcgaggggtacctcccgtgagcgtattctcgtcggcctaccacgttcgagggaaacccaccggcccaccgtgacccatcgacggtacgacgggtacggaaggccgggagtcggacggcccgtaacgttagttaccgtggtacgagggtggtagggtaattagggggttaggtgggtagacttacgacgttacgtacgttacggttccgttaaccgggaacgtcggggtaacctaacgggttccttccggtaccgttacgtaccgaccgacccgaacgggacccctaaaccccgagttccgtcctaccgttccgttcccggttccccgtccccg

SEQ ID NO: 433151 - DNA, 794 bp, Homo sapiens
  misc_feature: GZ8MTXP01EVWA2.4.57.F02.1.454.CMB.2.raw
  modified_base (149)..(149): a, c, t, g, unknown or other
  modified_base (226)..(226): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcagcccaccctcagtgtcagtcggcccagggcaggacggccaggataaccgtgtgtgggaaccngcagtcgggaaggtaaaagtgtaactagttggaacaggacaagaagccaaggccagggcccctggtggtggtcgtcgtatgatacgcgaccgcctcgagggactccctgagcgtattctctcggcctaccaaacgttcgacgggaaaaccacggccctaccccgtgaacccagtccacgggcgaacggggtcgaaaacgggccggggtaatcgggaacggtacccggtaaaccttaagttttacccgtacgggtacgaaggggttgggttaagggggaactttaaggggggttaaagggttgggggttaagtaacgttaccggtaaactttccccgtaaaagttacccgggttttaccgggttaacccgggtaaaacggtaccgggggtaaacccgtaaacgggggtttcccttaccccgggggttaccccttaaacgggttccccggaaacccggaaacccccccgttaaaacgggggaccccccaaaacccccccggttaacttcccggttaaccgttacccctttacccgtttaacccgggttttccccccccgttaaccccccg

SEQ ID NO: 433152 - DNA, 720 bp, Homo sapiens
  misc_feature: GZ8MTXP01ARXK7.4.57.F02.1.454.CMB.2.raw
  modified_base (320)..(320): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcaggtcggccccgaggggcacggaccgggccgaagggaactaaccgtggtaggtacggggaaccagcaagtacgggaaggtaaaagtgtaacagttggacaggcagaacgccaggccaggccctggtggtcggtcgtcgtangataggcgaccggcctgaggactcccgtgacgcgattctcgtcggcctaccaacgtcgtacgggaaaacccaccgggcccaacccgtacggaccacgtccgaacgggcgtacgggggtacgaacggggaccggggagtacgggacgggacccgtaacgttaactttacgtacggtacggtaaggggttgggtacggggtaagttaggggggttagggtggggtagtacgttacacggtacccttaagttaccggttacgttaacccggggtaaagtaccgggggaactaaacgggttcccgttacccggttacccgttaccgtaccgaaccgaccccgaaaccggttaccccaacccctacgtcggtaccctacgttcccttccgttccccgtaaccccc

SEQ ID NO: 433153 - DNA, 580 bp, Homo sapiens
  misc_feature: GZ8MTXP01DLPFV.4.57.F02.1.454.CMB.2.raw
  modified_base (344)..(344): a, c, t, g, unknown or other
  modified_base (448)..(448): a, c, t, g, unknown or other
  modified_base (498)..(498): a, c, t, g, unknown or other
  modified_base (524)..(524): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtggccccagggcagacggccaggataacctgtgtgggaaccagcatcggaaggtaaagtgtacattggtacaggcagaagccaggccacggcccctgtggtggtcgtcgtatgatagcgaccggccctcgagggactcccgtgacgcgtatttcccncgtggcctaccaaacctcgtacggggaaccaccgggcccaccctgacccagtcacgcgaggggtcgaacgggccggggatgggacggaccgtaactagttaccngtacgagggtggtaggggggataggtaggtggtgatcatccagtaccgtnttacggaagtcgggaacagggttccnccgttacaccgttcgacgaccccaaggcccaactcccacgttgtccaacgttcccg

SEQ ID NO: 433154 - DNA, 627 bp, Homo sapiens
  misc_feature: GZ8MTXP01A3IJT.4.57.F02.1.454.CMB.2.raw
  modified_base (292)..(292): a, c, t, g, unknown or other
  modified_base (443)..(443): a, c, t, g, unknown or other
  modified_base (482)..(482): a, c, t, g, unknown or other
  modified_base (585)..(585): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccaggcagacgcaggatactgtgtggaaccagcagtcgggaaggtaaaagtgtacagttggacaggcagaagccaggccaggccctggtggtggtcgtcgttangatgccgaccggccctgagggatccccgtgacgcgtattcctctcggcctacaactcgtaggggaaacccaccgggccaaccctgacccataccagcgaaggggtacgaaacgggccgggggtatagggacggcccgaacgttattaccgnggttacgagggtggtagggtagtaggggtaagttggggntatcacgtccaagttaccgtacgttacgggaacgttgggggaacccctaaggtccttacccggccttacggccaacggccccgaaacgggcccccaaaccccngttcccgtacctaccgttcccgttccggttcccccgttcccc

SEQ ID NO: 433155 - DNA, 638 bp, Homo sapiens
  misc_feature: GZ8MTXP01D3ALO.4.57.F02.1.454.CMB.2.raw
  modified_base (260)..(260): a, c, t, g, unknown or other
  modified_base (353)..(353): a, c, t, g, unknown or other
  modified_base (562)..(562): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagcgtggtttcctcgtgctctttaagaggtgtccagtgtcaggtgcaccgtgggtggaggtcgggggaggcgtggtccaggccgtgggggtccctgagctctcctgtgcngcgtctggacttcgccttcgagtgcctagtggcatgccacgtcgggccgccaggcctaccggaggccggaaggggctagggagtggggtacgntagttagtagttggttagagtacgtaactaaaaacaaactttcaagtgacgtaacgtaccgtcgggtaagggaaacgggtcctaactttccaaacccgatccctacgaagacgtactaagttaccggaaacaactaataattaacggaaactactaaagagtactaagtaactacggtagacggaagacggaaccggtagaacgcgttnttacgttatagtttagttggttacgaggtaagtaaggttaacggttcgtacgttacggttcggtttccgttaacgg

SEQ ID NO: 433156 - DNA, 702 bp, Homo sapiens
  misc_feature: GZ8MTXP01DE233.4.57.F02.1.454.CMB.2.raw
  modified_base (319)..(319): a, c, t, g, unknown or other
  modified_base (346)..(346): a, c, t, g, unknown or other
tcagagcactgtagcacgaccggtgctcgatttagctcgatatagttggggtttggggggcctaaggaagcagcactggtggtgcctcagccatggcctggaccgttctcctcctcggcctcctctctcactgcacaggctctgtgacctcatatgtgctgactcagccccaccctcagtgtcaggtcggccccgaggggcaggacggccaaggactaacgtggtggtacggaaccagcagtacgggtaaaggtaaagtgtaactagttggtacgaggcaagaacgccgaggccacggccctggtggtcgtcgtcgtangatcgccgaccgcctgaggtactccgnggagtcgtattcgtcgtccggcctaccgaacgtcggtacgggaaacccgcccggtcccacccgtacgaaccctacgtcccggaaggccgggtaacgggggtaccggaaacggggtcccgggggtagtacggggaaccgggtacccgtaaacgtttacgtttaccgtacgggtacggtaggggtgggtaaggggtagtttaaggggggttaaggttggggtagtactacgtacctcgtagttaaccggttcggttaaccggacgtacgggtaccgtaacgtccttacccggtccttacgcgaccgaccgaccggaccccaaccctgtccgtccacttccgtccgttcccccgttccc

SEQ ID NO: 433157 - DNA, 789 bp, Homo sapiens
  misc_feature: GZ8MTXP01CYW4L.4.57.F02.1.454.CMB.2.raw
  modified_base (344)..(344): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggcccagggcagacggcaggataacgtgtgaggaaccagcaagtcgggaaggtaaaagtgtaacagttggtaacaggacaggaacgccgaacggccacggcccgtggtcggtggtcgtccgttatggataggccgaccggccctggagggtactcccgngacgcgtacttctcgtcggcctaccgaacgtcgtacgggaaaaccacccgggcccacccgtacgaccctagtaccgaacggacggacggggtacggaaacggggcccgggggtaaatcggggaacggacccggtaaacgtttaacgttaccgttgggtaaccgtaaggggttggggttagggggaaagtttaggggggttacgggttagggggttactaacgtttaccgaacttaccgtaaacggtttaccgttccgggtttaaaccgggaaacgggttaaccgggggaacccgttaaacggggttccccgtttacccgggtaccgttaacccgtaccgaacccgggttaaccccgaaaccggggaaccccctaaccccccgttaaagtcccggttaccctaacccgttccccgttttaaccgttccccccccgtttaacccccg

SEQ ID NO: 433158 - DNA, 663 bp, Homo sapiens
  misc_feature: GZ8MTXP01ELEL4.4.57.F02.1.454.CMB.2.raw
  modified_base (296)..(296): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccagcatcggaggtaaaagtgtacattggtacaggcagaagccaggccaggcccctgtggtgtcgtcgtangatgcgaccggcctcgagggactcctgacgcgtattccctcgtggcctaccaacgtcgtacgggaacaccgggacccaccctgacctagtcaacgacgaggggtacgaacgggccggggatcggacggggcctaacgtacgttaacgtcgtcgagggttaggtacggggggtattaagggttaggtgggtagtacgtacctaattcccgaaagttacccggttcttaccgggggaaacgtcgggggtaaacccttaaaggggttccccttaccggttcccgttaaccggcccgttacggacccccgtaaaaggggccccctaaaaccggttccccaaccgtttcggtccccgttaaccgtttccccg

SEQ ID NO: 433159 - DNA, 720 bp, Homo sapiens
  misc_feature: GZ8MTXP01BQLKD.4.57.F02.1.454.CMB.2.raw
  modified_base (226)..(226): a, c, t, g, unknown or other
  modified_base (305)..(305): a, c, t, g, unknown or other
  modified_base (401)..(401): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcaggtcggcccgagggcagacgccaggactaacgtgtgacgggaaccngcagtacggaaggtaaagtgtacagttggacgaggcaagagccgaggccgacggccctggtcgggtcggtcgtcgttanggacgtacggccgaccccggccctcggacgggtacctcccgtaggacgcgtacttcgtcgtcggtcctaccgaacgtccggtacggggaaaacccnccgggcccacccgtcggaaccctagtccgacgggacgggaacggggtacccgggaaacggggacccgggggtagtacgggaaccggtaccgtaacgtttacgttacgtgggtacgtaggggtcgggttaaggggtagttaacgggggttaggttgggtacgtaacgtttacaaaccggttccgttaaggttacccggtttacgttaaccggggtaacgtaccgggtaaccgtaacgggtccgttacccgtaccgttaccgtaccgaccggacccgacggaccccaaccgtctcgtcccacgttcctccgttcccctccc

SEQ ID NO: 433160 - DNA, 649 bp, Homo sapiens
  misc_feature: GZ8MTXP01DUOXV.4.57.F02.1.454.CMB.2.raw
  modified_base (302)..(302): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtcggcccagggcaggacgcaggatactgtgaggacagcagtcgggaaggtaaagtgtacagttggtacaggcaagaacgccgaaggccacggcccctggtggtggtcgtcgttangatacgcgacccggccctcgagggctcccgtgacgcgtattccctcgcggtcctcccaacgtccgtagggaacccaccggacccacccgtcgaccctatcgagacgaggggtacgaacgggccggggaatcgggacggtaccgtacttacgttacgtagtcgtaggggttggtaggggggtagttaaggtaggtgggtacgatctactaccgtacgtaccgttccgttacggaacgttaacggggaaccaacgggttccttcccggtaccgttaccggaccgttaccggaccccgtaaccgggtaccctaaccgtcccgtaccgttcgttaacccgaactttccccg

SEQ ID NO: 433161 - DNA, 694 bp, Homo sapiens
  misc_feature: GZ8MTXP01AWG2S.4.57.F02.1.454.CMB.2.raw
  modified_base (283)..(283): a, c, t, g, unknown or other
  modified_base (317)..(317): a, c, t, g, unknown or other
  modified_base (560)..(560): a, c, t, g, unknown or other
  modified_base (628)..(628): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcaccgtggtggaggtcggggggagcgtggtccaggccgtgggggtccctgacgactctcctgtgcagcgtctggacttcgccttnagtgcctagtggcctatcgctacgtcgggtcccncgaggcctccgaggacgtaaagggggctagggaagtggggtagactagtttagtacgttgggtttagacgtaaggaaacctaaaagtaaatttcagtcgactaacgtacgttaccggaagggaacgggtccctattacccgaacctattacccgccgaaaggtaacgtaaacgttaacttacggaaacgtaaactaacgttacttaggggaaacttcgtaaacgagtaacgtaacgaaaccgngttaccgacggtaagaccggaccggaacggaacgtccgggttacttggttacttaagttagttacggngttaacgggtaagtaacgggttaagtccgggttattaacggtttccggtttaacccgtttaagggg

SEQ ID NO: 433162 - DNA, 852 bp, Homo sapiens
  misc_feature: GZ8MTXP01EVAAS.4.57.F02.1.454.CMB.2.raw
tcagagcactgtagcacgaccggtgctcgatttagctcgatatagttggggtttggggggaagaggaagactgacggtcctcccaggagttcaggtgctgggcaccgtgggcagtggggggaggcgtggtccagccgtggggggtccctgagactctcctgtgcagcgtctggattcgccttcagtgcctatggcatgcacgtgggtccgccaggctccgaggcgaaggggctggaagtggggtgactagttatagttggtttgagtaggaaactaacaaattctatgacagactccggtagaacgggcctattccaccgtatccgtaccgaaggacgtaaactaaacgttttacgaaacgtaaacactaagtttagaaactttacctaaacgtaagtaagttaaccggaaaacgttacggttacgtaagggaaacggtaaaccgggaccccgggaagggggaaaccctaccgggggttctttaacgggtttacttttaaagtttaacggttgggttacggacggtaaagggtaagggttaaagggttcggttacgttaaggtttccgggttttaccgttttacgggaacccggttacggggttacgggggtaacccgtaaccgggggtaaaccccggttcggggttaacccgtaacccggtttcccgttacccgtcgtaccgttaccccgtttaacccgaaaccccggtaaaccgggtccccctaacggttccccgggtttccccttcccccggttcgggcccccgttcccgttcggacccttacccggacgggttaccgcccgtaccgtccggggcggggacccaccggtcccgggcccgggttccccgg

SEQ ID NO: 433163 - DNA, 735 bp, Homo sapiens
  misc_feature: GZ8MTXP01D8XEN.4.57.F02.1.454.CMB.2.raw
  modified_base (216)..(216): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacgccagatactgtgnggaccagcagtcggaaggtaaagtgtacattggtacaggcagaagccgaggccaggcccctggtggtggtcgtcgttatgatagcgaccggcctcgacgggactccccgtagacgtcgatttcccgtcgtggcctccaaaccgtccgtagggaaccaccgggcccctaaccccgtgaaccccagtacgacggaccgaggggtaccggaaacggggcccgggggtaatacgggaacgggcccggtaactacgtttaacctggtccgtaaggggttggtaggggggtaattagggttaaggttggggttagaagttaccaacgttacccgtaacgtttacccgggttacgtttaccgggaaaccggttaacgggggtaaccccgttaaacggggttcccgttaccccggttacccgttaacccggttacccgaaccgggttacccccgaaacggggtaaccccctaaaacccggtttccccaaacccggtttccggttaacccgttaacccgttttccccg

SEQ ID NO: 433164 - DNA, 620 bp, Homo sapiens
  misc_feature: GZ8MTXP01EGWSF.4.57.F02.1.454.CMB.2.raw
  modified_base (228)..(228): a, c, t, g, unknown or other
  modified_base (299)..(299): a, c, t, g, unknown or other
  modified_base (435)..(435): a, c, t, g, unknown or other
  modified_base (469)..(469): a, c, t, g, unknown or other
tcagagcactgtagcacgaccggtgctcgatttagctcgatataggttgggtttgggggcctaaggaagcagcactgggtggtgcctcagccatggcctggaccgttctcctcctcggcctcctctctcactgcacaggctctgtgacctcatatgtgctgactcagccaccctcagtgtcagtcggccccaggggcagacggccaggactaaccgtgtgtggaaccngcagtcggaagtaaagtgtactagtggtacaggcagaagccaggccaggccctggtcggtggtcgtcgtangataggccgaccggccctgagggactccgtgagcgtattcgtcgtcggcctccgaagtcgtagggaaaacccacgggcccacccgtgacccatcgagcgagggtcgaagccgggatggacgccgtaatacttacgngtcgaaggtggtagtacgtaggggtagtcgggtnagtcgactccgaagtaccggttcttaccgggaacgttcgggaacctaaagggtccttaccggtaccgttacgtacgaacccggcccgaacggttaccccaaaccccggttgtccgtacctaccgttcccgttcccgttaacccctaacccg

SEQ ID NO: 433165 - DNA, 604 bp, Homo sapiens
  misc_feature: GZ8MTXP01DEF5P.4.57.F02.1.454.CMB.2.raw
  modified_base (400)..(400): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccgaggcgaaggggctggaagtggggtgcagttatagttggtttgataggaaactaaacaaattctatgcagactccgtgaacggcgatcacatctcagagaactaatttcgaagaacactatagaatctaacagactagaacagtctagagaacgccgaaggacacgggcttagtctattatgtgngagtagtaagtgtactagttcggttctttacgaccgtaggtcggggaccgtaacggggtaacccgttcgggtacctaaccggtctcctcgacgtccttacccgaaccgtacgggtccctacgtccgttcctccccgttcggtcccgttccgtcgccttccgcggttacgcctaccgtcggtcggggcacgcggcccggtcccgg

SEQ ID NO: 433166 - DNA, 689 bp, Homo sapiens
  misc_feature: GZ8MTXP01AIZKF.4.57.F02.1.454.CMB.2.raw
  modified_base (313)..(313): a, c, t, g, unknown or other
  modified_base (390)..(390): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccgaggggcaggacggccaaggactaaccgtggtggtagggaaccagcagtacgggaaggtaaaagtgtacagttggacaggacagaacgccgaggccacggccctggtggtcggtcgtcgtangactaggccgaccggcctcgagggactcccgtaggacgcgtattcctcgtcggcctacaacgtcgtacggaaaaccnccggcccacctgaccactcgacgcgacgggtcgacggcgggatcggacggcctaacttagttacgtggcggtagggtggtagggtagttaggggtaggtgggttagacgttaccgactccgtaagttaccggttccgtaacgggggaaccttcgggggaaaccctaacgggttcccttcccggtacccgttaccggtaccgaacccggttaccccgaaccgggttaccccctaaaaccccgtcgttaacccggtaccctacggtttaccccgttcccgtttaaccccccgtaacccccg

SEQ ID NO: 433167 - DNA, 555 bp, Homo sapiens
  misc_feature: GZ8MTXP01E4NM9.4.57.F02.1.454.CMB.2.raw
  modified_base (303)..(303): a, c, t, g, unknown or other
  modified_base (321)..(321): a, c, t, g, unknown or other
  modified_base (433)..(433): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtagggaaccagcagtcggaaggtaaaagtgtacattggtacaggcagaagccaggccaggcccctggtggtggtcgtccgtangatagcgaccggcccctnagggactccctgagcgattcctctggctacccactcgtcgggaacaccgggacccaccctgaccatcgacgcgagggtcgaaggccggggatggacggccgacgtattacgngtcgaggtggtagggggataggtagtggtagatcataccatacgtcttcgggaacgtggggaaccaggtccttccgtacctacgcacgcccgaaggccaacctccacttgtccaacttcccg

SEQ ID NO: 433168 - DNA, 689 bp, Homo sapiens
  misc_feature: GZ8MTXP01EH5LI.4.57.F02.1.454.CMB.2.raw
  modified_base (218)..(218): a, c, t, g, unknown or other
  modified_base (224)..(224): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctcagtgtcagtcggccccaggcagacgcagactacgtgtgnggaacngcagtacggaagtaaagtgtacagttggacaggcaagacgccgacggccacggccccgtggtggtcggtcgtccgtatgatcgcgacccggcctcgagggactccgtgacgcgtacttcccgtcctcggtacctacccgtaaaccgtccgtacggggaaccgtacccgggaccccaaccccgttacggaaccctacgtacgacgggtaccgaacgggggtaccggaaacggggacccgggggatcggggaacggaccgtaacttaacgttacgttggtacgtaggggttggtaggggggtagttagggttaaggtggtagacgtactacgtaccagttaccggtcgttaaccgggaacgtcgggtaaccgttaacggtcccgttccgttaaccgtaccgttcgaccggttaccccgaaggaccctaaacccgtcccgaacttcgtaacccgttaacgtttccccg

SEQ ID NO: 433169 - DNA, 602 bp, Homo sapiens
  misc_feature: GZ8MTXP01D0D66.4.57.F02.1.454.CMB.2.raw
  modified_base (175)..(175): a, c, t, g, unknown or other
  modified_base (224)..(224): a, c, t, g, unknown or other
  modified_base (308)..(308): a, c, t, g, unknown or other
  modified_base (378)..(378): a, c, t, g, unknown or other
  modified_base (458)..(458): a, c, t, g, unknown or other
  modified_base (492)..(492): a, c, t, g, unknown or other
  modified_base (496)..(496): a, c, t, g, unknown or other
tcagagcactgtagcacgaccggtgctcgatttagctcgatataggttggggtttgggggcctaaggaagcagcactggtggtgcctcagccatggcctggaccgttctcctcctcggcctcctctctcactgcacaggctctgtgacctcatatgtgctgactcagcccacctnagtgtcaggtcggcccgagggcagacggcaggatacgtgtgaggaaccngcagtacgggaaggtaaaagtgtaactagttaggtacaggcaagaaacgccaaggccgaggcccctggtggtcggtcgtcgtangataggccgaccgcctgagggactccgtgagcgattctacgtcggcctacaacgtcgtacgggaaaaccnccgggcccaccctcgaacctatcgaacggcgaaggggtacgaacgggtccggggatcggacggtacgtactacgttacgngtacgagggtgtagggtataggggtagtgggtanactnactctagtacgtcgtacggaacgtcgggactaaggtccttccgtaccttacgcacgttacccgacgttacccaaccctatcgtcacttccgtccttccctaacccg

SEQ ID NO: 433170 - DNA, 590 bp, Homo sapiens
  misc_feature: GZ8MTXP01BSUNG.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggagcgtggtccagccgtgggggtccctgagactctcctgtgcagcgtctggattcgccttcagtgcctatggcatgcactgggtccgccagcctccgaggcgaaggggctggaagtgggtgctagttatagtggtttgagtggaaactaaacaaattctaagtggacacgtaccgtcggtaggaaacgggtccgtattaccaccgactacctaccgaagtacggaactaactttacgaacgtaactactaagttggaaactcttaacagtatagaaccgtgtactgagagccgaacggaacgtaacggctaggttctattagttgttcggagtaaggtagtaacgtggtacgttagtcggttccgtttaacggg

SEQ ID NO: 433171 - DNA, 709 bp, Homo sapiens
  misc_feature: GZ8MTXP01CD9Z5.4.57.F02.1.454.CMB.2.raw
  modified_base (311)..(311): a, c, t, g, unknown or other
  modified_base (339)..(339): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctcagtgtcaggtcggccccgagggcagacggcaggactaacgtgtgaggaaccagcagtacggaaggtaaagtgtacagttggacgaggcaagaacgccgacggccacggccccgtggtggtggtcgtcgttangagtcgcgaccggcctagaggcctccgngacgcgtacttcctcgtcggtcctaccgaacgtccggtacgggaaccacccgggtacccctaacccgtacgaaccccgtacgtaccggaaacggtacccgggtaacgggggtaaccgggaaaaccgggggcccgggggtaagttacggggaacgggtacccgtaaacgtttacgttaccggtagtacggtaggggttgggtaagggggtaagttaggggttaaggtgggtatacgtacacttaccgtagttaccgtcgttacgggaacgtccggggtaaccttacggggttcccttaccggttccgtacgttaccgccggacccgtaacggccctaaacgtccacgttcgtaacccttaacgtttccccg

SEQ ID NO: 433172 - DNA, 728 bp, Homo sapiens
  misc_feature: GZ8MTXP01D5MK1.4.57.F02.1.454.CMB.2.raw
  modified_base (260)..(260): a, c, t, g, unknown or other
  modified_base (263)..(263): a, c, t, g, unknown or other
  modified_base (267)..(267): a, c, t, g, unknown or other
  modified_base (272)..(272): a, c, t, g, unknown or other
  modified_base (292)..(292): a, c, t, g, unknown or other
  modified_base (295)..(295): a, c, t, g, unknown or other
  modified_base (306)..(306): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctcagtgtcaggtcggccccagggcaggacggccagactaacgtgtgtaggaaccagcagtacggaagtaaagtgacagttganagnagancagcncgcctggtgtgtcgtcgtangancgcgaccgccncgaggctccgtagacgtcgtacttcctcgtcgtacctacccgaacgtcggtacgggaacccgacccggacccctaaccccgtacgaaccctacgtacggaacgacgggtaacgggggtaaccggaacggggtaccggggaagtacgggtaaaccgggtcccgtaaaacgtttacgttaccggtagtacgggtaaaggggttggggtaacggggggttaaggtttaagggttaaggggttggtaacgtacgttaccttaaaccgtaccgttaacgttacccgggtttacggttaaccgggaacggttaaccggtaacccggttaacggttccccgttacccgtaccgttaaccgttaccgttaccgacccccgaaggacccctaaccgtccgtaccgttacgttccgttaaccctttccccgg

SEQ ID NO: 433173 - DNA, 610 bp, Homo sapiens
  misc_feature: GZ8MTXP01EH61J.4.57.F02.1.454.CMB.2.raw
  modified_base (215)..(215): a, c, t, g, unknown or other
  modified_base (225)..(225): a, c, t, g, unknown or other
  modified_base (450)..(450): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacgccaggataaccngtgtggaccngcatcggaagtaaaagtgtacattggtacaggcagaagccaggccacggcccctgtggtggtcgtccgtatgatacgcgaccggcctcgaggactccctgacgtcgattccctctggcctacccaacgttcgagggaaccaccgggccaaccctcgaacccatcagcagggtcaaggccggggaatggacggccgatattacagtcaggtgtgggggatagtagnggtcgatccagttaccagttacgtcgttacggaacgtcgggtaaccgaaagggttccccttaccggttacccgtttaacggaccttaccgggaccccaaaaaggggccccaaaaacgttccccgaacttccggttaaaccgttaaccttttaaccccggg

SEQ ID NO: 433174 - DNA, 794 bp, Homo sapiens
  misc_feature: GZ8MTXP01CMTAX.4.57.F02.1.454.CMB.2.raw
  modified_base (334)..(334): a, c, t, g, unknown or other
tcagagcactgtagcacgaccggtgctcgatttagctcgatatagttgggttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcacgtgggtccgccaggctccgaggcgaagggggctgggaagttggggtggctagttatagttgggttagatagggaaactaaactaaattctatgcagactccgtagaacgggccgtattccacctatcctaccaaganaactaactttacgaagtaaacactaattagaaacttctaacagtaatacgaaacagtctaggacgaaacgggacggaacggacgaaccgggtctttaggtactttaagtttagtcggttaggacggtaagggttaaggttaaagggttcgggttactaaggttttcgggtttaccgttttacgggaacccggtaggggttccgggggaacccgtaaccgggggttaaaccccggttcggggttacccgtaaccccggttacccgttccgtacccgtaccgtacccgtttaaccccgaacccgggtaaacccggggtacccctaaccggttcccgggtttccccgttaccccccggttcgggtccccgttaccccgttcgtcccgttccggacgggttacccgcccgtcccggttccggggacgggggtaccgacccggtcgggccccgggttccccgggg

SEQ ID NO: 433175 - DNA, 726 bp, Homo sapiens
  misc_feature: GZ8MTXP01DE4CK.4.57.F02.1.454.CMB.2.raw
  modified_base (326)..(326): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacgcaggataactgtgtggaaccagcagtcggaaggtaaaagtgtacagttggacaggcagaacgccaggccacggcccctggtggtggtcgtccgttatgatagccgaccggccctcgacgggactcccgngacgcgtattccgtcgtccggcctaccgaaacgtccgtaggggaaaacccaccgggccccaaccccgtgaaaccctataccgaggcggaacggggtaccgaaacgggcccgggggaatcgggaacgggtacccgtaacgttaagttaccgtaggtacgaggggtggtaggggtaagttaagggggttaggttagggtagtaacgtacctaacgtacccgtaagtttacccggttcggttaaccggggtaaaccgtaccggggaaacccgtaaacgggttccccgttaccccggtacccgttaaccggtacccgtaacccggacccccgaaaccgggaccccctaaacccccgacgttcgtacccgtaccctttcccgttccccgttccccccgttccccc

SEQ ID NO: 433176 - DNA, 754 bp, Homo sapiens
  misc_feature: GZ8MTXP01BLRWR.4.57.F02.1.454.CMB.2.raw
  modified_base (153)..(153): a, c, t, g, unknown or other
  modified_base (179)..(179): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcacgcccaccctnagtgtcaggtcggccccagggcaggacggccaggataccgtgtgtggaaccagcagtacggaggtaaagtgtacattaggtacaggcaggaagccgaggccgacggccccgtggtggtggtcgttccgtagtgagtacggcgacccgggccctacgagggtactcccgtggacggcgtattcccgtccgtacggccctaccgaaccgttcggtacggggtaacccacccgggcccctaaacccgtcgaacccaagtcgacggaccggtagggggtaacccgaacgggggcccgggggtaattccggggaaaccgggtaccccgttaaacgtttaacgttaaccgtacgggttaccggtagggggttgggtacggggggggtaagttaacggggttgggttaggggttagtaacgtccggttaactacccgttaaggttacccgttaccggtttaccggggaaacgtcggggtaaacccgttagggttccccttccgggttacccttaccggttaccgaccggaccccgtaacgggacccctaaccgtccctacgttcgtaaccttccgttccccg

SEQ ID NO: 433177 - DNA, 625 bp, Homo sapiens
  misc_feature: GZ8MTXP01E1N3S.4.57.F02.1.454.CMB.2.raw
  modified_base (369)..(369): a, c, t, g, unknown or other
  modified_base (444)..(444): a, c, t, g, unknown or other
  modified_base (483)..(483): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggcacggataacctgtgtaggaaccagcagtacgggaaggtaaaagtgtaacagttggtacaggcagaagccaggccaggccctggtggtggtcgtcgtatgatgcgaccgcctgagggactcccgtgagcgtattctctcggcctacaacgtcgtacggggaaaaccnccggcccaccctgaacccagtccaggcgaggggtaccgaaagggccggggatcggacggccgtaacgtattacgnggtacgagggtggtagggtagttaggggtaggtgggtanatcgaacttccgaagttaccggttacgttaccgggaaacgttcggggaaaccctaagggtcccttaccggtcccttacggcgaacgaccccgacggaccccaacccacgtcgtacctacttcctaaccgttcccctaacccc

SEQ ID NO: 433178 - DNA, 643 bp, Homo sapiens
  misc_feature: GZ8MTXP01AUXYA.4.57.F02.1.454.CMB.2.raw
  modified_base (212)..(212): a, c, t, g, unknown or other
  modified_base (396)..(396): a, c, t, g, unknown or other
  modified_base (454)..(454): a, c, t, g, unknown or other
  modified_base (514)..(514): a, c, t, g, unknown or other
  modified_base (520)..(520): a, c, t, g, unknown or other
  modified_base (611)..(611): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgccaccctcagtgtcagtcggccccgagggcagacgcaggataacgngtgtacggaacagcagtacgggaagtaaaagtgtaactagttggtaacaggacaaggaacgccgaggcccgacggtccctggtggtcggtcgtaccgttataggtactacggcccgacccggcctacggagggtactcccgtaggactcgtattcgcgtcgcctacgaactcgacggaaaaccnccggtccacccgtagaacccagtcgaacggtcgaacggggtacgaagggccggggaancgggacggacctaacgttataccgtggtacgagggtggtgggtaagtagggtggttaggntacgtnaacctcgtaacgtacggttactaacggtacggtcggaaccctaaggttccttcccgtcaacgtacaccggacccgaacgaccccaaccctntaacgtccaccgttcctcccgttcccaacccc

SEQ ID NO: 433179 - DNA, 768 bp, Homo sapiens
  misc_feature: GZ8MTXP01BMCG3.4.57.F02.1.454.CMB.2.raw
  modified_base (266)..(266): a, c, t, g, unknown or other
tcagagcactgtagcacgaccggtgctcgatttagctcgatatagttggggtttggggggaagaggaagactgacggtcctcccaggagttcaggtgctgggcaccgtgggcagtggggggaggcgtggtccagcctggggggtccctgagactctcctgtgcagcgtctggattcgccttcagtgcctatggcatgcacgtgggtccgccaggcctccgaggcgaagggggctgggaagtggggtggctagttatagttggtttnataggaaactaactaaattctatgacagactccggtaggaacgggccgtattcaaccatcctaccagaacgaactaatttacgaagaaactactaagttacgaaattctaacaagtataacgaaactaggtactggaacgaacgaccgggaaggaccgaacggggtcttacggttacttagtttaagttgtacggaggtaagtaagggttaaaggtcggttacgtagtttcgggtttacctttacgggaaccggtaggggtacggggtaccgtaacggggtaaccccgggttcggggttaccgtacccggtttacctcccgtaccgtacgttacccgttaaccccgaaccggtaaccggggtcccttaaccgggttcccggtttaacccccgttcccccggttcgggtccccgttcccgttcggcccgttaccggccgggttaaccgcccgtacccggttcgggtccggggggaccaccggccgggttcccgggtccccggg

SEQ ID NO: 433180 - DNA, 738 bp, Homo sapiens
  misc_feature: GZ8MTXP01AQDLJ.4.57.F02.1.454.CMB.2.raw
  modified_base (149)..(149): a, c, t, g, unknown or other
  modified_base (173)..(173): a, c, t, g, unknown or other
  modified_base (224)..(224): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcagcccacctnagtgtcaggtcggccccagggcaggacggcaggactaactgtgaggaaccngcagtggaagtaaagtgtacattggtacaggcagaagcaggccaggccctgtggtggtcgtcgtatgatagcgaccggcctgagggactcccgtgacgcgtattcctcgtcggacctccgaaacgtcgtacggggaaaaccacccgggcccaacccgtcggacccactacgacggacgaagggggtaccgaacgggccgggggatcgggaacgggtaccgtaaaccttagttacccgtaggtaccggtaaagggtcgggttaggggttaagttaagggggttaacgggttcggggttaggtaacttacccgtaacgttaccgtaacccgtttaaaccggttccgtttaaccggggaaaccggttaccggggtaacccgtaaagggttccccgtttacccgggtacccctttacgggtacccgtaacccgaacccccgttaacggggacccccaaaaacccctcgtaacggtacccctaacttccccgtttcccgggttaaccccccttcccccg

SEQ ID NO: 433181 - DNA, 723 bp, Homo sapiens
  misc_feature: GZ8MTXP01CV1CJ.4.57.F02.1.454.CMB.2.raw
  modified_base (650)..(650): a, c, t, g, unknown or other
tcagagcactgtagcacgaccggtgctcgattagctcgatatagttggggtttggggggaagaggaagactgacggtcctcccaggagttcaggtgctgggcaccggtgggcagtggggggaggcgtggtccagccgtgggggggtccctgagactctcctgtgcagcgtctggattcgccttcagtgcctatggcatgcacgtcgggtccgccaggcctccgagggcgaagggggctagggaagtgggggtggctagttatagttgggtttagagtaggaaactaaacaaattctatgcagactccggtaggaacgggccgtattccacctatcctccagagactaatttcgagaacactattagaatctaacgagtatacgaaacagtcgtaggaggaaacggccggaaggaccacgggtcttaggtactttatttaacgttgggtacgacggtaagggtaaggttaaggttcgggtactaaggtttccgggtttacgtttcgggaaccggttaggggttccgggggaccggtaacgggggtaaccccgggttcgggttaccccgtacccgggttcctcccgtcgacgtccttaccccgaccgtaaccggggccctacgtcccggtccccttccccgttcgggtcccncccgtacgtcccgttacccgcgggaccgtcccgaccgttcgggcgggggccacggtccggcccgggtcccggg

SEQ ID NO: 433182 - DNA, 697 bp, Homo sapiens
  misc_feature: GZ8MTXP01CDQ4X.4.57.F02.1.454.CMB.2.raw
  modified_base (232)..(232): a, c, t, g, unknown or other
  modified_base (396)..(396): a, c, t, g, unknown or other
tcagagcactgtagcacgaccggtgctcgatttagctcgatatagttgggtttggggctgggcctaaggaagcagcactggtggtgccccagccatggcctggaccgttctcctcctcggcctcctctctcactgcacaggctctgtgacctcatatgtgctgactcacgccaccctcagtgtcagtcggccccgagggcaggacgccaggactaacctgtgtacggaaccngcaagtcggaaggtaaagtgtacagttggacaggacagacgccaggccacggccctggtcggtggtcgtcgttatgatcgccgaccggtccctcgacgggtactcccgtaggacgcgtatttccgtccgtcgggtacctaccgaacgtcgtaaacggggaaccnccgggtaccctaacccgtacgaacccagtaccgacggtaccggacggggtaccgaaacgggccgggggagtcgggaacggtacccgtaaacttacgttaacgtcgtacggtaggttgggtagggtaacgttaggtaggttggagtacttacgactcgtacgtccgttacgttacgggtaacgtccgggtaaccgtaacggttccctacccggttaccgtaccggtccgttaacggaccccgttaacgggtaaccctaaacctccggtacttacggttaccctaacctttccgttaaccccg

SEQ ID NO: 433183 - DNA, 701 bp, Homo sapiens
  misc_feature: GZ8MTXP01BJKSU.4.57.F02.1.454.CMB.2.raw
  modified_base (227)..(227): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctcagtgtcagtcggccccagggcaggcgcaggataccgtgtgtggaaccngcagtacggaagtaaagtgtacagttggacaggcaagagccgaggccacggcccctggtggtggtcgtcgtatgatacgcgacccggcctcgagggtactcccgtagacgtcgtacttcccgtcgtcggtcctacccgaaacctcggtaccgggaaccgacccgggacccctaacccgtacggaacccaacgtaccgaagggacccggtagggggtaaccggaaacgggggtaccgggggtaacgtacgggtacgggtaacccgtaacgtttaacgttaccgttcggttaccggtaggggttagggtaggggggtagtttaagggtaggttcggggtaatacgtctagttaccctaagttccggtaccgttaccgggaacgtcggggaaaccttacggttcccttccggtaccgtaccggttacgaccgacccgaacggtcccaacgtccacgttcgtaaccttaacgttcccg

SEQ ID NO: 433184 - DNA, 635 bp, Homo sapiens
  misc_feature: GZ8MTXP01ECW4Z.4.57.F02.1.454.CMB.2.raw
  modified_base (217)..(217): a, c, t, g, unknown or other
  modified_base (223)..(223): a, c, t, g, unknown or other
  modified_base (292)..(292): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggacgcaggatactgtgnggaacngcagtcggaagtaaagtgacattggacaggacagaagccaggccaggcccctgtggtggtcgtcgttangatagcgaccggcctgagggactcccgtgacgcgtacgttcctcgtcggtcctacccaaacgttccgtaggggaaccaccgggcccacccggttcgaaccctagtacgacgacgtaggggtacgaaacgggcccggggattgggaacggccgtaacgtacgttaaccgtgtacgaggttgggagggggtaataggtaggtgggtacgtatcctaagttaccaagttaccgttacgtaccgggtaagtaaccggggaaccttaacgggtcccttacccgtacccgttcgaccgcgaccccgaaggtacccctaacgtccctacttcgtcccgaacgtttccccg

SEQ ID NO: 433185 - DNA, 683 bp, Homo sapiens
  misc_feature: GZ8MTXP01DSUIL.4.57.F02.1.454.CMB.2.raw
  modified_base (217)..(217): a, c, t, g, unknown or other
  modified_base (223)..(223): a, c, t, g, unknown or other
  modified_base (311)..(311): a, c, t, g, unknown or other
  modified_base (343)..(343): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccaccctcagtgtcaggtcggcccgagggcagacggcagataacgtgtgnggaacngcagtacgggaaggtaaagtgtaactagttggtacaggacaaggaacgccgaggcccgacggtccctggtggtcggtcgtacgttagngatacgccggacccgcctacgaggtctcccgngagtctattccgtcgtccgcctaccacgtcgacgggaaaaccctccggcccaccgtacgaacccatcggaggcggtaaggggtacggaacgggccggggaatcgggaacggtacccgtaacttagtttactaggcggtaaggtggtagggtaattagggggtaggttggtataacgttcgacttccgtaaagtttccggtacgttacggggaacgttccggggtaacctaacggtttccccttaccggtcccttaacggtaccgacccgaacccgaaccggttaaccccaacccgttcgttaacgtaccctccttccgttaacccgtttccccctaaccc

SEQ ID NO: 433186 - DNA, 645 bp, Homo sapiens
  misc_feature: GZ8MTXP01BT28O.4.57.F02.1.454.CMB.2.raw
  modified_base (376)..(376): a, c, t, g, unknown or other
  modified_base (391)..(391): a, c, t, g, unknown or other
  modified_base (612)..(612): a, c, t, g, unknown or other
tcagagcactgtagcacgaccggtgctcgatttagctcgatataggttgggtttgggggcctaaggaagcagcactggtggtgcctcagccatggcctggaccgttctcctcctcggcctcctctctcactgcacaggctctgtcgacctcatatgtgctgactcacgcccacctcagtcgtcaggtcggccccagggcaggacggccaggactaaccgtgtggtacggaaccagcagtacgggaagttaaagtgtatagtggtacgaggcagaagccgaggccaggccctggtggtcggtcgtcgtatgatagccgaccgcctcgacggtactcccgtgagcgtatcgtcgtcgctacaacgtcgtacggaaacnccgccacctagaccntacgacggcggaagggtcggaaggccgggagtcggacgggactaacgtattcgtagcgtacgggtggtagggtaagttagggggtaggtacggggtatacggttacacgtcccgtaaaggttacccgtacggttaccgggaacggttacgggacccgtaagggtcccttaccgggttcttacggtacccgcggttaacccgacccggacccaaacccggtntccgtacctcttccggttaaccgttccctcccc

SEQ ID NO: 433187 - DNA, 616 bp, Homo sapiens
  misc_feature: GZ8MTXP01AUL1W.4.57.F02.1.454.CMB.2.raw
  modified_base (250)..(250): a, c, t, g, unknown or other
  modified_base (260)..(260): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagccgtggggggtccctgagactctcctgtgcagcgtctggattcgccttcagtgcctatggcatgcacgtcgggtccgccaggctccgaggcgaagggggctggaagtgggtgctagttntagtggtttnataggaaactaacaaattctatgcagactccgtagacgggccattccaccatctaccagaagactaatttcgaagaacactatttagaatctaacagatacgaacagtactggaagaacgacccggaaggacacgggtctgtacttattagttgtgcgaagagtaagtgtgtagtgttactttgaccgtagtcgggacgacgggaccgtggtccaccgttctccctcgacgtccttacccgacgtaaccgggcctaccgttccggtcccttccccgttcgggcccgttcccgtacgtccttacccgcggaccgccgtacccgtcgggttcgggccgacgtccggcccggtcccggg

SEQ ID NO: 433188 - DNA, 608 bp, Homo sapiens
  misc_feature: GZ8MTXP01A15FX.4.57.F02.1.454.CMB.2.raw
  modified_base (394)..(394): a, c, t, g, unknown or other
  modified_base (410)..(410): a, c, t, g, unknown or other
  modified_base (462)..(462): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcaggtgtcgaggtccggaccccgagggcacggaccggccaaggacttaaccgtggtaggtacgggaaaccaggcgagtacggggaaaggtaaagtgtactagttggacaggacgagaacgccacggccacggccctggtggtggtccgtcgtatgatcgcgccgcctgacggctccagagcgtattccgtctcggcctacgacgtccgagggaaccnccggaccctacccgtnaccagtcgagtcgaggggtcgaacgggcgggatcggacggctatacgttagngtgagggtggaggggtagtaggtagtggagtatacgcttacgtacgtaccgttcggtacggacgtcggaaccgttcggttcccttcgtaccgtcgacgcgacccgaaggtcccaacgtcctacggttctaacccttccgtttcccg

SEQ ID NO: 433189 - DNA, 643 bp, Homo sapiens
  misc_feature: GZ8MTXP01EUUJ2.4.57.F02.1.454.CMB.2.raw
  modified_base (327)..(327): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccacctcagtgtcaggtcggccccgagggcaggacggcaggactaaccgtggtggtacggaacagcagtacgggaaaggtaaagtgtaactagttcggaacgaggacgaagaacggccgacggccgacggtcccgtggtcggtggtccgtcgttangacgtacggccgaccggtcctacggaacgggtcctccgtagacgcgtactttccgcgtcggccctaccgaaccgttcggaacgggaacccgacccggacccacccgtacgaccagtacgacgacggtacggggacggaacggggtccggggagtaccgggaacggaccgttaacgttacgttacggtcgtaggtaaggggttggtagggggtagttagggtaggttgtagactcgatccgtagttcgtacgtagacgtggacagtccgttacgtctcgacgcgaccgaagccaactcgattccgtaacttccgtcc

SEQ ID NO: 433190 - DNA, 621 bp, Homo sapiens
  misc_feature: GZ8MTXP01ENAZJ.4.57.F02.1.454.CMB.2.raw
  modified_base (344)..(344): a, c, t, g, unknown or other
  modified_base (463)..(463): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggactaactgtgtggaaccagcagtcggaaggtaaatgtacagttggacaggcagaagcaggccaggcccctggtggtggtcgtcgtatgatacgcggaccggcctcgagggactcccgtagacgtcgtattcccncgtcggccctaccaacgtcggtaccgggaaccgacccggccctacccgtacgaccctatcgaacggcgaggggtacggaacgggccgggggatcgggacgggtacctacgttattacgnggtcgtaagggtggtaggggggattagggtaggtgggtacattcgaactaccgtaacgttacggtcttaacgggacgtaacgggtacttacgggttccttaccgtccgtacgttcgacgacccgtaaggcccaactccgattccgtaacttccttccg

SEQ ID NO: 433191 - DNA, 598 bp, Homo sapiens
  misc_feature: GZ8MTXP01A34JC.4.57.F02.1.454.CMB.2.raw
  modified_base (220)..(220): a, c, t, g, unknown or other
  modified_base (333)..(333): a, c, t, g, unknown or other
  modified_base (571)..(571): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcagtcggccccaggcagacggcaggatacctgtgtggaaccngcatcgggaagtaaagtgtacattggtacaggcagaagccaggtccaggccccctggtgggtggtcgttccggttactgatagtccggacccggccctccgagggatccctgngacgacttctctccgcgtccaacgtctgggaaccaccgggtcccaccctcgaccactcagacgacgggttacggaaggccgggggagtcggaggacccgaacgtacttaacgtgtactagggtggttagggagtagggtagttgggtaggtcactctccgtaagttaccgttacgttcggaccgtacggggctaaacggtcttacccggtccacgtcacgccccgacggcccaacccnctcgcacttcctcgttcccctaacccc

SEQ ID NO: 433192 - DNA, 633 bp, Homo sapiens
  misc_feature: GZ8MTXP01EIK8S.4.57.F02.1.454.CMB.2.raw
  modified_base (314)..(314): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagcttgggtttttcctcgttgcttcttttaagaggtgtccagtgtcaggtgcaccgtggtggaggtcgggggaggcggtggtccagccgtgggggtcctgagctctcctgtgcagcgtctggacttcgccttcagtcgcctatggcatgccacgtggggtcccnccgaggcctcgaggccgaagggggctagggaagtggggtgctagttatagttggtttgagtaggtaaactaaaacaaattctatgacagtacgtcggtagaacgggccgtattcacatctccaagagactaattcgaagaacatacttaggaaacttctaacagtagtacgaacgtagtacgtcggtaaagacggaccggaagggaacccgaacgggttcgttacggttaccttaaagtttagtttacgttggttaccgggtaaggtaaggttaaggttcgggtaccttaagtttcgggtttaaccgttttaaccgggg

SEQ ID NO: 433193 - DNA, 632 bp, Homo sapiens
  misc_feature: GZ8MTXP01ACA6K.4.57.F02.1.454.CMB.2.raw
  modified_base (173)..(173): a, c, t, g, unknown or other
  modified_base (218)..(218): a, c, t, g, unknown or other
  modified_base (364)..(364): a, c, t, g, unknown or other
  modified_base (468)..(468): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctnagtgcagtcggcccaggcagacgcaggatacgtgtgtaggaaccngcagtacggaaggtaaaagtgtacagttggtacaggcagaacgccaggccaggcccctggtggtggtcgttccgtatgatacgcggaccggcctcgagggactcccgtgagcgtattctcgtccggctcaacgtcgtacggaaacnccgcccaccgtgaccatcgagacgaggggtacaagggccgggatcggacgccgtaactattaccgtgtcgtagggtggtagggagttaggggtaggtaggggtntaacgtcgtaacgtcgaacgtttaccggtccgttacgggtaaacgtcggggaaccgtaacgggttccttcccggtaccgttaccggtaccgaccggacccgttaaacgggccccaaaccccgtggtaacgttccacgttcccgttaaccgttcccctaaccccg

SEQ ID NO: 433194 - DNA, 647 bp, Homo sapiens
  misc_feature: GZ8MTXP01D2LV7.4.57.F02.1.454.CMB.2.raw
  modified_base (293)..(293): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcagtggccccaggcagacggcaggataactgtgtggaaccagcagtacgggaaggtaaaagtgtacagttggacaggcaagacgccaggccacggccctgtggtggtcgtcgtangatcgcgaccgcctgaggactccgtgagtcgtacttctcgtcggcctaccaacgtcgtacggaaaacccaccggcccacccgtcaaccacgtaccgaggacgacggggtaccgaacgggccggggagtacggacgggaccgtaacgttagttacgtgtacgtagggtggtagggtattagggggtaggttggtagatcgtactccgtaagttacgttcgttacgggtaacgtcgggaaccgtaacgttccgttaccgtccgttaacggtacccaaccgggaccccgttaacggacccccaaaccccgttccttcgtaccctacctttccgttaacccgttccccgtaacccccg

SEQ ID NO: 433195 - DNA, 782 bp, Homo sapiens
  misc_feature: GZ8MTXP01BBXWF.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccaccctcagtgtcaggtcggccccgagggcaggaccggccaaggtactaaccgtggtagtacggggaaccaggccaagtacgggaaaggttaaaagtgtaactagttggtacgaggcaagaacgccgaaggccgacggcccctggtgggtcggtccgtaccgttatggtaacgtcgccggacccggtcccctacggacggggaccctcccgttaggacgtacgtaactttcgtaccgttcggtacctaccgaaccgttccggtacggggaaaacccaccccgggccctaaccccgtcggaaaccccagtcccgaacgggcgaacgggggttaccgaaacggggtccgggggaatcgggaacgggtacccgtaaacgttacgttaacgtcgggtacgtaagggggttggtaggggtagttaaggggggtggttaggggcgtaactccgaacgtcccgaggtttaacggtccggttaaccgggtaaacggttcccggggaaaccttaagggtccccttaccggtcccgttacgtcgaacccggaacccccgttacggaacccccctaacccgtagtccggtacctacccttccggtccccgttcccctaacccccg

SEQ ID NO: 433196 - DNA, 593 bp, Homo sapiens
  misc_feature: GZ8MTXP01E4D50.4.57.F02.1.454.CMB.2.raw
  modified_base (301)..(301): a, c, t, g, unknown or other
  modified_base (370)..(370): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggactaacctgtgtaggaaccagcagtcgggaaggtaaaagtgtacattggacaggcagaagccaggccacggccctgtggtggtcgtcgtangatagcgaccggcctgaggactccctagacgcgtattcctcgtggcctacccaactcgtacgggaaccnccgggcccaacccgtgaacccatcgagacgaggggtacgaaacgggccgggaatggaacggccgtaacttattcgtgtcgagggtggtagggggattagggtaggtggtagatcgactccagttaccgtcgttacggacgtcgggaaccagggtccttcccgtacgtacgcgacgacccgaacgggccctaaaccgttccacgttcgtaaccaacgtttcccg

SEQ ID NO: 433197 - DNA, 551 bp, Homo sapiens
  misc_feature: GZ8MTXP01AHZO5.4.57.F02.1.454.CMB.2.raw
  modified_base (178)..(178): a, c, t, g, unknown or other
  modified_base (229)..(229): a, c, t, g, unknown or other
  modified_base (260)..(260): a, c, t, g, unknown or other
  modified_base (302)..(302): a, c, t, g, unknown or other
  modified_base (316)..(316): a, c, t, g, unknown or other
  modified_base (324)..(324): a, c, t, g, unknown or other
  modified_base (336)..(336): a, c, t, g, unknown or other
  modified_base (410)..(410): a, c, t, g, unknown or other
  modified_base (451)..(451): a, c, t, g, unknown or other
  modified_base (455)..(455): a, c, t, g, unknown or other
  modified_base (514)..(514): a, c, t, g, unknown or other
  modified_base (543)..(543): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgccaccctnagtgtcagtcggccccagggcagacggcaggatacctgtgtacgggaaccngcatacgggaggtaaaatgtacagttggacnggacagaacgccaggccacggcccgtgtggtgtcgtcgttangatgcgaccgcagnggactccngcgcgtattccncgtagcctaccacgtgtacggaacccgggcccacgtcgaccagtccgagcgagggtacggaacggccggggtanggacggcctatactacgtgcgagggtgaggggtataggtgnggtnactgagtaccctagttcgtcgttacggagttcggaaccttaggtcttcccgtactccgngacgaccaaggcccaacgccagttctccncgttcccg

SEQ ID NO: 433198 - DNA, 547 bp, Homo sapiens
  misc_feature: GZ8MTXP01CSWZT.4.57.F02.1.454.CMB.2.raw
  modified_base (219)..(219): a, c, t, g, unknown or other
  modified_base (402)..(402): a, c, t, g, unknown or other
  modified_base (411)..(411): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcgacctcctctctcactgcacaggctctgtgacctcatatgtgctgactcagccacctcagtgtcagtgcccagggcagacgcagataacctgtgtggaacngcatcggaaggtaaaagtgtacattggtacaggcagaagccaggccaggcccctgtggtggtcgtccgtatgatagcgaccggcctgagggactccctgacgcgtattccctctggcctaccaaactcgtgggaaccacggccaccctgaccatcagcaggtcgaagcgggatgagcgatatngtcaggtgnggggataggtcgtggcgatcattaccagtacgtcttacggaactggggaaccaacgggttcttacccggttacccgtacgttccgcgaccccaagggaccccaaacttcccaacgttcgtcccgttaactttcccg

SEQ ID NO: 433199 - DNA, 824 bp, Homo sapiens
  misc_feature: GZ8MTXP01CUM0L.4.57.F02.1.454.CMB.2.raw
  modified_base (226)..(226): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggcccgagggcagacggcaggataacctgtgtacggaaccngcagtacgggtaaggtaaagtgtaactagttaggtaacgaggacagaacgccgaggccgacgggcccctgggtcggtcgggttccgttaccgttagtacggtacgtacgggaccggtaccccgggcccctacggtaggggtacccttcccgtagggacgtaccggtactttcgtccgtcccggtccctaccgacgttccggtacggggaaaacccgtccgggccccaacccgtaccgaaccgtactaccggacgggtacggaacgggggtaccggaaacgggaccgggggtactacggggaccgggtaacccgtaagttacgttacgtacgggttacggtaggggttgggtaggggttaagttaggggggttaggttgggttacgtaaccgtagttaaccgtccgtaaacggtttacccggttaccggttaaccgggtaaaccggtcgggggtaaaccccgttaacggggttcccgttacccgggttaccccgttaccggttaaccgcccgttaccccggaacccggttacccccgaaaccccgttacgtcccggtacctaccccgttcccgtccccggttccccccggttaaccccc

SEQ ID NO: 433200 - DNA, 665 bp, Homo sapiens
  misc_feature: GZ8MTXP01DDCV9.4.57.F02.1.454.CMB.2.raw
  modified_base (233)..(233): a, c, t, g, unknown or other
  modified_base (396)..(396): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgccgactcacgccaccctcagtgtcagtcggccccgaggacgagacggccaggataacctgtgtgggaaccagnagtacggaaggtaaaagtgtacagttggtacgaggcagaacgaccgaggccacggcccgtcggtggtcggtcgtccgttagtgagtacgccgaccggcccctcgagggtactcccgtggagcgtacttcctccgtcggctacctaaccgtcgtacgggaaccnccggcccaacccgtacgaccactcgacgacgtacggggtacgaacggcccggggatacggacggaccggtacttaattacgtagtcgagggtggtgggtaagtacggttaggtggtagaatcgacgtctaacgtcgtaccgtttacggacgttacgggggaacctaaacgggttccctaccgttacccgtacgggtacaacccggccggaaaccggaaccctaaaccctccgtaacccgttcggaccttaaccttcccgggtttccccg

SEQ ID NO: 433201 - DNA, 760 bp, Homo sapiens
  misc_feature: GZ8MTXP01BWXCK.4.57.F02.1.454.CMB.2.raw
  modified_base (228)..(228): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccngcagtcgggaaggtaaagtgtacattggtacaggcagaagccgaggccaggcccctggtggtggtcgtccgttatgatcgccgacccggccctacgagggtactccccgtggacgcgtactttcccgtacgtcgggccctacccgaaccgttcggtacggggaacccgaccggggacccccaccccgtcggaaccctcgtaccgacggaccggtaagggggtaccggaaacgggggccgggggtaagtcgggaacggggacccggtaacttacgtttaaccgtcggttaccggtaaggggttgggtaggggggtaagttaggggttagggtcgggttaggacttccgaacgttacccgtacggtttaccggttacccggtttaccgggggaaaccgttcgggggaaacccgttaacgggggttccccttacccgggtacccgttacccgggttaccgaccccgggaccccgtaaaccgggtacccctaacccttcccgaaccgttcggttaacccgttaacctttcccccgg

SEQ ID NO: 433202 - DNA, 599 bp, Homo sapiens
  misc_feature: GZ8MTXP01DOS57.4.57.F02.1.454.CMB.2.raw
  modified_base (216)..(216): a, c, t, g, unknown or other
  modified_base (218)..(218): a, c, t, g, unknown or other
  modified_base (292)..(292): a, c, t, g, unknown or other
  modified_base (336)..(336): a, c, t, g, unknown or other
  modified_base (364)..(364): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggccctcctctctcactgcacaggctctgtgacctcatatgtgctgactcacgcccaccctcagtgtcagtcggccccagggcagacgcagatactgngnggacagcagtggaagtaaagtgtacatggacaggcagaagccaggccacggcccctggtggtgtcgtccgttangatacgcgacccggcctcgagggctccgtgacgcgtactttccncgtggcctaccaacgtccgagggaaccnccgggaccaccctgacccatcgacgcgaggggtacgaagggccggggatcggacggtccgattacgtactgtcgagggtggtagggggtataggttaggtgtagactcgacgtacctagttcgttacgtacggtaacgtaacgggaaccttacgggttccttcccgtaccgtcgttacccgacggacccccgaaggtaccccaaccgttcccgaattccgtccttaacgttcccg

SEQ ID NO: 433203 - DNA, 685 bp, Homo sapiens
  misc_feature: GZ8MTXP01EQZNO.4.57.F02.1.454.CMB.2.raw
  modified_base (149)..(149): a, c, t, g, unknown or other
  modified_base (249)..(249): a, c, t, g, unknown or other
  modified_base (288)..(288): a, c, t, g, unknown or other
  modified_base (294)..(294): a, c, t, g, unknown or other
  modified_base (330)..(330): a, c, t, g, unknown or other
  modified_base (375)..(375): a, c, t, g, unknown or other
  modified_base (417)..(417): a, c, t, g, unknown or other
  modified_base (483)..(483): a, c, t, g, unknown or other
  modified_base (515)..(515): a, c, t, g, unknown or other
  modified_base (655)..(655): a, c, t, g, unknown or other
  modified_base (663)..(663): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcagccccacccctgtagtcgtacgacggtcccggacccggaggacgaacggaccgacgaagtaacttaaccgtggtaggacggaacngataggtacgggtaaagtaagtgtatagtacggagaganaagacncgacggcgccgtccgtggtcggtcgttcgtagtagngacgtcggacccgaccgtcctaggacgtcctcgtagacgtacgtnttcctcggtccgaccctacgaacgtccggtaacggaaacccncccgaacccttaccgacgacctacaccggacggtacgggtaacgggtaccggaaacgggcgggtanaccggggtaccgtacgttaaacttagttcggnggtacgggtagggtggtaaggttacgtaaggggtggttcggatcctagcgtacgtacgttacgtcggtacggaaacgtcggaaccgtaacgttcccgttctacccgttagccaacccgttacgaccgttaccccaacgtntcgttacnccttcgtccccttaaccctccg

SEQ ID NO: 433204 - DNA, 647 bp, Homo sapiens
  misc_feature: GZ8MTXP01C9VDT.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcagatacctgtgtggaaccagcatcgggaaggtaaagtgtacattggtacaggcagaagccaggccaggccccctggtggtggtcgtccgtttatgatagcggaccgggccctccgagggactcctgagcgattcctctggctccacgtctgggaaccgacgcccgaccctcgaccatcagcgaggtacggaggcggggagtggtacggccggtactacttaacttagtcgtacgggtgtaggggggacggttaagttaggggtaggtggttaacacggtactaccgaacgttaccggttacgttcccggggtaaacggttaaccgggggtaaacgaccggggttaaccgttcccgtttaaccccggtaacgttccccgacggaacccccgtaacggaaccccgtaactaccccgtaccttacgtccccgttaaccttcccg

SEQ ID NO: 433205 - DNA, 622 bp, Homo sapiens
  misc_feature: GZ8MTXP01C89LD.4.57.F02.1.454.CMB.2.raw
  modified_base (582)..(582): a, c, t, g, unknown or other
tcagagcactgtagcacgaccggtgctcgatttagctcgatatagttgggtttggggggaagaggaagactgacggtcctcccaggagttcaggtgctgggcaccgtgggcagtggggggagcgtggtccagcctggggggtccctgagactctcctgtgcagcgtctggattcgccttcagtgcctatggcatgcacgtgggtccgccaggctccaggcgaagggggctggaagtggggtgctagttatagttggtttgaataggaaactaaactaaattctatgacagactccgtaggaacggccgtatcacatcctcagagactaatttacgaagaacactaatagaatctaacagatacgaactagtctagaagaacgacgaaggacacggtcttagtcttattagtgtagtacgagtagtaaggttgtacagttcggttctttagaccgtagtcggggaccgaacgggtacccggtcgtcgtaccgtcgtcctccacgtccttacccgaccgtaacggtccctacggtcccgtcccgtccccgttggcccgttcccgtcgccgttaccgcgggaccnccgtaaccgtcggtcgggaccttacggcgcccggtcccgg

SEQ ID NO: 433206 - DNA, 673 bp, Homo sapiens
  misc_feature: GZ8MTXP01ALXXG.4.57.F02.1.454.CMB.2.raw
  modified_base (238)..(238): a, c, t, g, unknown or other
  modified_base (318)..(318): a, c, t, g, unknown or other
  modified_base (320)..(320): a, c, t, g, unknown or other
  modified_base (391)..(391): a, c, t, g, unknown or other
  modified_base (505)..(505): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctcagtgtcaggtcggccccagggcacgacggccaggactaaccgtggtggtacgggaaccngcaagtcggtaaggtaaagtgtactagttggtacaggcaagacgccacggccacggcccctggtggtcggtcgtcgttangntacggccgaccggcctcgaggtcctccgtgacgcgtattcctcgcggtcctaccacgtcgtacgggaaccnccggtacccaccctacgaccactcacggcgacggggtacgacgggccggggtatgggacgcgtacttagtacctggtacgtagggtgtagggggtattacggtggtggtagacncgtacgtaccgtaacggttaccgttaccgggttaacggtaaccgggtccgggtaaaccgttaacgggttccccttacccggtaccgttaccggttaccgaccggttaaacccccgaagggtacccccaacgttccccgtacgttcctaacccgttaacctttcccccg

SEQ ID NO: 433207 - DNA, 678 bp, Homo sapiens
  misc_feature: GZ8MTXP01BEUTG.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtgccccaggcagacggcagataacctgtgtggacagcagtcggaaggtaaaagtgtacattggtacaggcagagccagcaggccctgtgtggtcgtccgtatgagtagcgaccgccctacgacgggtatcccgtagagcgtacgttccgtcgtggtacctacctaaactcccgttagggaaccacgggcccaaccccgttacgaacccactacaacggccgtaacgggtacggaaacggccgggggtatacgggacggacccgtacgtaacttacgacggtacgtaagggttcggtaggggggtaacttaagggttaggtgggtaagtctacgtactaccgtaagttaccgggttaccttaccggaaaacgttcgggaaaccgttacggttccgttcccgtacccgttaacgttacccgaacgacccccgaaaagggtccccctaaaaccttccccgtaaacgttccggtaacccttaacccgtttaaccccgg

SEQ ID NO: 433208 - DNA, 644 bp, Homo sapiens
  misc_feature: GZ8MTXP01C91D6.4.57.F02.1.454.CMB.2.raw
  modified_base (260)..(260): a, c, t, g, unknown or other
  modified_base (325)..(325): a, c, t, g, unknown or other
  modified_base (502)..(502): a, c, t, g, unknown or other
tcagagcactgtagcacgaccggtgctcgatttagctcgatatagttggggtttggggggcctaaggaagcagcactggtggtgcctcagccatggcctggaccgttctcctcctcggcctcctctctcactgcacaggctctgtgacctcatatgtgctgactcagccaccctcagtgtcagtcggcccagggcaggacgcaggataacctgtggtggaaccagcagtacgggaagtaaagtgtaacagttggacaggnagaacgcaggccaggccctgtggtcgtcgtcgtatgatacgccgccgccctgagggtactcccgngacgcgtactctcgtccggcctcaacgtccgtacggggaaaccaccgcccgtaccacgaaccgactcggaagcgaaggggtacgaaacgggccggggatcggaacgggtccgtaaactacgttacgtcgtacggagggttgtaggggagttaagggggttaaggttagggtgtaacncgtaactacgtaacgttaccggttacttaacgggaacgtacgggtaaaccgtaacggtaaccttcccggttaaccacggtaccaccgaccgacgaccccaacccgtactaaccgctaccttcgttcccttcccctaaccccc

SEQ ID NO: 433209 - DNA, 343 bp, Homo sapiens
  misc_feature: GZ8MTXP02HSOQ9.4.57.F02.1.454.CMB.2.raw
  modified_base (339)..(343): a, c, t, g, unknown or other
tcagagcactgtagcacgaccggtgctcgatttagctcgatatagttgggttgggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggccaggataacctgtgtgggaaccagcatcggaggtaaagtgtacattggtacaggcagaagccaggccaggcccctgtggtggtcgtccgttatgatagcgaccggcctcagggatccctgagcgggctggcaaggcgcatagnnnnn

SEQ ID NO: 433210 - DNA, 512 bp, Homo sapiens
  misc_feature: GZ8MTXP02JI1HV.4.57.F02.1.454.CMB.2.raw
  modified_base (401)..(401): a, c, t, g, unknown or other
  modified_base (491)..(491): a, c, t, g, unknown or other
tcagagcactgtagcacgaccggtgctcgatttagctcgatatagttgggtttggggcctaaggaagcagcactggtggtgcttcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggcctcagggatccctgagcgattctctcggctccaactctgggaacacggccacctgaccatcagcagggtcgaagccgggatgaggccgatatacngtcaggtgtgggatagtagtggtgatcatccatacgtcttcggaactgggaccaaggtctccgtctacgtcacgcccaaggcccaacccnctcgcactctcgttcccgccc

SEQ ID NO: 433211 - DNA, 653 bp, Homo sapiens
  misc_feature: GZ8MTXP02JH05A.4.57.F02.1.454.CMB.2.raw
  modified_base (223)..(223): a, c, t, g, unknown or other
  modified_base (253)..(253): a, c, t, g, unknown or other
  modified_base (292)..(292): a, c, t, g, unknown or other
  modified_base (372)..(372): a, c, t, g, unknown or other
  modified_base (489)..(489): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggccaggataacctgtgtagggaaccngcagtacggaagtaaagtgtacagtggacnggcagagccgaggccacggccctggtggtgtcgtcgtangatacggcgaccggcctgacgggtactcccgtgacgtcgtattccgtcgtccggcctaccgaactcggtacgggaaaccnccgggcccaccgtacggaccagtcgaggcgaggggtacgaacgggcccggggatcgggacggcccgtattaacgttcgtggtacgagggttggtagggtattagggtaggtgggtanacttacacgtaccgtaagttaccggttacgttaccgggaacgttcggggaaccgtaacgggtttccctacccggttaccgtaacgtccgaaccgacccgtaacggtacccctaaaccccgtcttaccgtcctaccgtttccgttacccgttccccctaaccccg

SEQ ID NO: 433212 - DNA, 513 bp, Homo sapiens
  misc_feature: GZ8MTXP02JYUHQ.4.57.F02.1.454.CMB.2.raw
  modified_base (411)..(411): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgtattccctctggctccaactctgggacacgggccacctgaccatcagcagggtcgaagccggggatgaggccgactattacngtcaggtgtgggatagtagtgggtgatcatccatacgtctacggaactcgggacaaggtctaccgtctacgtcacgcccaaggccaactccatcgtcactcc

SEQ ID NO: 433213 - DNA, 506 bp, Homo sapiens
  misc_feature: GZ8MTXP02GLNCQ.4.57.F02.1.454.CMB.2.raw
tcagagcactgtagcacgaccggtgctcgatttagctcgatatagttgggtttgggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcgagggatcccgtgagcgattcctctggctccaactctgggacacggccaccctgaccatcagcaggtcgagcgggatgagccgatatactgtcaggtgtgggatagtagtggtgatcgatccatacgtcttcggaactggaccaggtctaccgtctacgtcacgcccgaaggccaaacgtccactcgcactc

SEQ ID NO: 433214 - DNA, 503 bp, Homo sapiens
  misc_feature: GZ8MTXP02JJ149.4.57.F02.1.454.CMB.2.raw
  modified_base (402)..(402): a, c, t, g, unknown or other
tcagagcactgtagcacgaccggtgctcgatttagctcgatatagttgggtttgggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggcctcagggatccctgagcgattcctctggctccaactctgggacacggcaccctgaccatcagcaggtcgaagccggggatgagccgatatacngtcaggtgtggggatagtagtgggtgatcatccatacgtcttcggaactgggaccaaggtctccgtctacgtcagcccaaggccaactccactcgtcactc

SEQ ID NO: 433215 - DNA, 509 bp, Homo sapiens
  misc_feature: GZ8MTXP02GOFSK.4.57.F02.1.454.CMB.2.raw
  modified_base (355)..(355): a, c, t, g, unknown or other
  modified_base (409)..(409): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattcctctggctccaactctgggacncggccaccctgaccatcagcagggtcgaagccggggatgaggccgactattacngtcaggtgtgggatagtagtggtgatcatccatcgtctcggaactgggaccaggtctccggtctacgtcagcccaaggccaacgtccactcgtcacttcc

SEQ ID NO: 433216 - DNA, 516 bp, Homo sapiens
  misc_feature: GZ8MTXP02IWLXG.4.57.F02.1.454.CMB.2.raw
  modified_base (514)..(514): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaaccacggccaccctgacccatccagcagggtcgaagccggggatggaggccgactattactgtcaggtgtgggatagtagtgtgatcatccatcgtcttcgaatgggaccaaggtctccgtctacgtcagaccccaaggccaacccactcgtcactctcgttccccncc

SEQ ID NO: 433217 - DNA, 614 bp, Homo sapiens
  misc_feature: GZ8MTXP02GQWR0.4.57.F02.1.454.CMB.2.raw
  modified_base (353)..(353): a, c, t, g, unknown or other
  modified_base (405)..(405): a, c, t, g, unknown or other
tcagagcactgtagcacgaccggtgctcgatttagctcgatatagttgggtttgggctgggcctaaggaagcagcactggtggtgcctcagccatggcctggaccgttctcctcctcgctcctctctcactggcacgaggacgtctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcaggggatccctgagcgattcctctggctccaacttcngggacacggccaccctgacccatcacgcaggtacggaacgaccggggagggnggacggaccgtacgtacgttacgtacgtacgtaggtggtagggtaggttaggttaggttagggtaggtagtacgtacgtaccgtacgttaccgttaccgttacggtaacggtacgggtaccggtaacggtaccgtacccgtacccgtaccgtaccgtaccgacccgaaccggacccgtaaccgtacctaccgtaccgtacctacctccg

SEQ ID NO: 433218 - DNA, 525 bp, Homo sapiens
  misc_feature: GZ8MTXP02G5DQT.4.57.F02.1.454.CMB.2.raw
  modified_base (223)..(223): a, c, t, g, unknown or other
  modified_base (352)..(352): a, c, t, g, unknown or other
  modified_base (523)..(523): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggagtaaagtgtacattggtacaggcagaagccaggccaggcccctgtggtggtcgtccgtatgatagcgaccggcctcgagggactccctgacgcgattctctcggctccaactctgggaacncggccacctgaccatcagcagggtcgaaggccggggatcggaggccgactatactgtcaggtgtgggataggtagtggtgatcagttccatacgtcttacggaactggggacctaagggtctccggtcctacgtcacgcccaaggccaacccgctcgtcactctcgtcccncc

SEQ ID NO: 433219 - DNA, 514 bp, Homo sapiens
  misc_feature: GZ8MTXP02FQXZZ.4.57.F02.1.454.CMB.2.raw
  modified_base (400)..(400): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggcctcagggatccctgagcgattctctggctccaactctgggaacacggccacctgaccatcagcagggtcgaagccgggatgagccgactatacngtcaggtgtgggatagtagtggtgatcatccatacgtcttcggaactgggaccaaggtctcgtcctacgtcacgcccaaggcccaacccgactcgtcactctcgttcccacccc

SEQ ID NO: 433220 - DNA, 532 bp, Homo sapiens
  misc_feature: GZ8MTXP02JB73V.4.57.F02.1.454.CMB.2.raw
  modified_base (350)..(350): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagcaggccaggcccctgtggtggtcgtccgttatgatagcgaccggccctcagggatccctgagcgattctctggctccaactctggaacncggccaccctgaccatcagcagggtcgaagccggggatggagccgactattactgtcaggtgtgggatagtagtggtgatcatccatacgtcttcggaactgggacctaagggtctaccgtcctaacgtcacgccccaaggcccaaaccccgactcggtccactcctcggtttcccccgccc

SEQ ID NO: 433221 - DNA, 506 bp, Homo sapiens
  misc_feature: GZ8MTXP02GT12Q.4.57.F02.1.454.CMB.2.raw
  modified_base (303)..(303): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggaggcgtggtccagcctgggggtccctgagactctcctgtgcagcgtctggattcgccttcagtgcctatggcatgcactgggtccnccaggctccaggcaaggggctggaatggggtgcagttatagtggtttgatggaactaacaaattctatgcagactcgtgaagggccgattcacatctccagagacaattcgagaacacattagaatctacagatagaacagtctgagagccgagacacggctgtctattatgtgcgaagagtaagtggtacagtcgtctttag

SEQ ID NO: 433222 - DNA, 550 bp, Homo sapiens
  misc_feature: GZ8MTXP02IZ0BN.4.57.F02.1.454.CMB.2.raw
  modified_base (523)..(523): a, c, t, g, unknown or other
tcagagcactgtagcacgaccggtgctcgatttagctcgatatagttgggtttggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccattcaccatctccagagacaatttcgagaacacattgaatctacagatgaacagtctgagagccgaggacacggctgtctattattgtgcgagagtaagtggtcatggtctttcgtaccagtggggtccgacggaacccgtcggtcgaccgtccgtcctcacgcttcctaccaacggcccgactcggtccttccccctcgcgcccgtcgctccgtagacgcaccgtcgtcggggcgaccgacgccggcccgtcgggcgtcggccgtcggtcgaaacggactaccgttccctaacncgtcgcgtctcgacgcggcgtcggcgg

SEQ ID NO: 433223 - DNA, 529 bp, Homo sapiens
  misc_feature: GZ8MTXP02FO3TA.4.57.F02.1.454.CMB.2.raw
  modified_base (410)..(410): a, c, t, g, unknown or other
  modified_base (503)..(503): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcagggactccctgagcgattctctggctccaactctgggaacacgggccaccctgaccatcagcagggtcgaagccggggatggaggccgactattacngtcaggtgtgggataggtagtggtgatcatccatacgtcttcggaactgggaccaaggtctccgtcctacgtcacgcccaaggcccaaacccnctcgtaccactctcgttccccgcccc

SEQ ID NO: 433224 - DNA, 624 bp, Homo sapiens
  misc_feature: GZ8MTXP02G9H0U.4.57.F02.1.454.CMB.2.raw
  modified_base (222)..(222): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaaggtaaaagtgtacattggtacaggcagaagccaggccaggcccctgtggtgtcgtcgttatgatagcgaccggcctcgaggacgtccctgagcgtatctctcggctccactctcggaacgacgccgacctcgaccactcagcgagggtacgaaggccggggatcggacggccgtaaccgtattaacgtcgttcgaggtggtagggtagtaggtaaggttgggtagtagtactatccgtaacgttacggttacgttccgggtaaacggtacgggtaacccgtaaaacgggtaccgttcccggttacccgttacgtaccgaccgaccccgaacgggaaccccaacccccgtaaactcggtacaaccctccgtttcccgtacccctttaacccccc

SEQ ID NO: 433225 - DNA, 559 bp, Homo sapiens
  misc_feature: GZ8MTXP02GUKSQ.4.57.F02.1.454.CMB.2.raw
  modified_base (290)..(290): a, c, t, g, unknown or other
  modified_base (556)..(556): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggacaggcagaagccaggccaggcccctgtggtgtcgtcgttangatagcgaccggcctcgagggactcccgtgacgcgtattctctcggcctccaactcgtaggggaacaccgggcccaaccctgacccatccagcagggtcgaaaggcccgggggatcggacggcccgacttacttacgtgtcgagggttgtaggggattaggtagtgggtagagtcactccgatacgtcttcggaacgtgggaacctaacggtctccgtccgtacgtcacgcccaaggcccaacccgctacgtcactctcgttcccnccc

SEQ ID NO: 433226 - DNA, 516 bp, Homo sapiens
  misc_feature: GZ8MTXP02JRC21.4.57.F02.1.454.CMB.2.raw
  modified_base (465)..(465): a, c, t, g, unknown or other
  modified_base (485)..(485): a, c, t, g, unknown or other
tcagagcactgtagcacgaccggtgctcgatttagctcgatatagttgggtttggggaagaggaagactgacggtcctcccaggagttcaggtgctgggcaccgtgggcatggggaggcgtggtccagcctgggggtccctgagactctcctgtgcagcgtctggattcgccttcagtgcctatggcatgcactgggtccgccaggctccaggcaaggggctggaatgggtgcagttatatggtttgatggaactaacaaattctatgcagactccgtgaaggccgattcaccatctccagagacaatttcgagaacacattgaatctacagatgaacagtctgagagccgagacacggctgtctattattgtgcgagagtaagtgtcagtgtcctttgaccagtgggccagggaaccctggtcaccgtctcctcagcttccacacggccagtccgtctccccgngccgcctcgcctccgaggcnccgaccgtcgtcggggccacgacgcggcccg

SEQ ID NO: 433227 - DNA, 519 bp, Homo sapiens
  misc_feature: GZ8MTXP02GJT0V.4.57.F02.1.454.CMB.2.raw
  modified_base (405)..(405): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcgagggatccctgacgcgattctctggctccaactctgggaaccacggccaccctgaccatcagcagggtcaagccggggatgaggccgatatacngtcaggtgtgggatagtagtggtgatcatccatacgtctcggaactgggaccaaggtcctccgtcctacgtcacgcccaaggcccaacccgctcgtcactctcgttcccgcccc

SEQ ID NO: 433228 - DNA, 511 bp, Homo sapiens
  misc_feature: GZ8MTXP02IRZJ8.4.57.F02.1.454.CMB.2.raw
  modified_base (437)..(437): a, c, t, g, unknown or other
  modified_base (457)..(457): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggcaggataacctgtgtggaaccagcatcggaggtaaaagtgtacattggtacaggcagaagccaggccaggcccctgtggtggtcgtccgtatgatagcgaccggcctcagggatccctgagcgatctctcggctccaactctgggaacacggccaccctgaccatcagcagggtcgaagccggggatgaggccgactatactgtcaggtgagggatagtagtgtgatcatccgatcgtnttcggaactggaccaggtcnccgtctacgtcacgccaaggccaaccccgatcgtacactcctcgttccccaccc

SEQ ID NO: 433229 - DNA, 546 bp, Homo sapiens
  misc_feature: GZ8MTXP02H6X7P.4.57.F02.1.454.CMB.2.raw
tcagagcactgtagcacgaccggtgctcgatttagctcgatatagttgggttgggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaggtaaagtgtacatggtacaggcagaagccaggccaggcccctgtggtggtcgtccgttatgatagcgaccggccctcgagggatccctgagcgattcctctggctccaactcgtagggacacggccaccccgtgacccatccagccagggcgaaaggccgggggatgacggccgactattacgtgtcaggtgtgggattaggtagtggtgatcgaatccgattaccgtcgttacggaacttcggggacctaaaggtctccgtacctacgtcacgacccaaggcccaaacgtcctactcgtccaacttcccg

SEQ ID NO: 433230 - DNA, 504 bp, Homo sapiens
  misc_feature: GZ8MTXP02F0A4L.4.57.F02.1.454.CMB.2.raw
  modified_base (409)..(409): a, c, t, g, unknown or other
  modified_base (436)..(436): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattcctctggctccaactctgggacacggccacctgaccatcagcagggtcgaagccggggatgaggccgactattacngtcaggtgtgggatagtagtggtgatnatcatacgtctcgactgggacaggtctccgtctacgtcagcccaaggccaactccactcgtcactccg

SEQ ID NO: 433231 - DNA, 521 bp, Homo sapiens
  misc_feature: GZ8MTXP02JWCMJ.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaagtaaagtgtacattggtacaggcagaagccaggccaggcccctgtggtggtcgtccgtatgatagcgaccggccctcgagggatccctgagcgattcctctggctccaactctgggacacggccaccctgaccatcagcaggggtcgaaggccgggggatggagggccgactattactgtcgaggtgtggggatagtagtgggtgatcattccatacgtcttacggaactcgggaccaggtctaccgtcctacgtcagcccaaggccaactcactcgtcactcc

SEQ ID NO: 433232 - DNA, 536 bp, Homo sapiens
  misc_feature: GZ8MTXP02JFFSI.4.57.F02.1.454.CMB.2.raw
  modified_base (353)..(353): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctatgtgacctcatatgtgctgactcagccaccctcagtgtcagtggccccagggcagacggccaggataacctgtgtgggaaccagcatcggaggtaaagtgtacattggtacaggcagagccaggccaggcccctgtggtggtcgtccgttatgatagcgaccggccctcgaggggactccctgagcgattctctggctccaactctgggaacncggccacctgacccatcagcagggtcgaaggccggggatgaggccgatatactgcaggtgtggggataggtagtggtagagtcatccatacgtcttcggaactggggaccctaagggtcctccgtccgtacgtcacgacccaaggcccaaccccgactcgtaccactcctcgttccccgcccc

SEQ ID NO: 433233 - DNA, 517 bp, Homo sapiens
  misc_feature: GZ8MTXP02JNAY5.4.57.F02.1.454.CMB.2.raw
tcagagcactgtagcacgaccggtgctcgatttagctcgatatagttgggtttggggaagaggaagactgacggtcctcccaggtgtccagtgtcaggtgcacctggtggagtcgggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctcagagacaatttcgagaacacattgaaatctaacagatgaacagtctgagagccgaggacacggctgtctattattgtgcgagagtaagtggtcatggtctttgaccagtggggcagggaaccctggtcaccggtctcctcagctccaccaaggccatcggtcttcccctcggcgccctcgctccaggaacgcacctcgtcggggcacgcgccgg

SEQ ID NO: 433234 - DNA, 530 bp, Homo sapiens
  misc_feature: GZ8MTXP02GQH48.4.57.F02.1.454.CMB.2.raw
  modified_base (359)..(359): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtgggaaccagcatcggaggtaaaagtgtacattggtacaggcagaagccaggccaggcccctgtggtggtcgtccgttatgataggcgaccggccctcgagggactccctgagcgattcctctggctccaactctggggacncggccacctgacccatcacgcagggtcgaaggccggggatgaggccgactatactgtcgaggtgtggggatagtagtgggtgaatcatccatcgtcttcggaactggggaccaaagggtcctccggtcctacgtcacgacccaaggcccaaactcccactcgtccactccg

SEQ ID NO: 433235 - DNA, 510 bp, Homo sapiens
  misc_feature: GZ8MTXP02I5QGN.4.57.F02.1.454.CMB.2.raw
  modified_base (355)..(355): a, c, t, g, unknown or other
  modified_base (406)..(406): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattcctctggctccaactctgggacncggccaccctgaccatcagcagggtcgaagccggggatgagccgatatacngtcaggtgtgggatagtagtggtgagtcatccatcgtctggaactgggaccaagggtctaccgtcctacgtcagcccaaggcccaaacgtccactcgtcacttc

SEQ ID NO: 433236 - DNA, 512 bp, Homo sapiens
  misc_feature: GZ8MTXP02I4D02.4.57.F02.1.454.CMB.2.raw
  modified_base (407)..(407): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggagtaaagtgtacattggtacaggcagaagccaggccaggcccctgtggtggtcgtccgttatgatagcgaccggccctcagggatccctgagcgattcctctggctccaactctggggaccacggccaccctgaccatcagcaggtcgaagccgggatgaggccgactatacngtcaggtgtgggatagtagtggtgagtcatccatacgtcttacggaactgggaccagggtctaccgtcctacgtcagcccaaggccaactccactcgtcactccg

SEQ ID NO: 433237 - DNA, 574 bp, Homo sapiens
  misc_feature: GZ8MTXP02JII83.4.57.F02.1.454.CMB.2.raw
  modified_base (296)..(296): a, c, t, g, unknown or other
  modified_base (365)..(365): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacggccaggataacctgtgtagggaaccagcagtcggaaggtaaaagtgtacattggtacaggcagaagccaggccaggcccctggtggtggtcgtcgttangatagcgaccgcctgaggactcccgtgacgcgtattctcgtcggcctaccaactcgtacggggaaaccnccgggcccacccgtgacccatccgagtcgaaggggtaccgaacgggcccgggggatcggacgggacccgacttacgttacgtgtcgagggtgtagggattaggtaggtggtagatcatccagtacgtcgttacggaacgtcgggacctaacggtcctccgtcctacgtcacgcccgagacccaaccgctcgcactctccgtccctaccc

SEQ ID NO: 433238 - DNA, 536 bp, Homo sapiens
  misc_feature: GZ8MTXP02ISCMS.4.57.F02.1.454.CMB.2.raw
  modified_base (227)..(227): a, c, t, g, unknown or other
  modified_base (416)..(416): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaggtaaagtgtacattggtacaggcagaagccaggccaggcccctgtggtggtcgtccgttatgatagcgaccggccctgagggatccccgtgagcgattcctctggctccaactcgtgggacacgggccacccgtgaccatcagcgagggtcgaaggccgggggatggaggccgatatacngtcaggtgtgggattagtagtgggtgactcaagtccagtacgtcgttacggaacgttcgggacctaagggtcctaccggtccttacgcacgcccaaggtcccaaactcactcgacactcc

SEQ ID NO: 433239 - DNA, 545 bp, Homo sapiens
  misc_feature: GZ8MTXP02HXQOC.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctccagagacaatttcgagaacacattgaatctacagatgaacagtctgagagccgaggacacggctgtctattattgtgcgagagtaagtggtctagtggttcttttgacctagtcggggccagggaaccctggtcaccggtctccctcacgcttccacgaacgggcccactccggtccttcccccgtcggccgccctcgcctccgacggacgccaccgtcgtcgggggcaccgacgccggcccg

SEQ ID NO: 433240 - DNA, 537 bp, Homo sapiens
  misc_feature: GZ8MTXP02JDQM0.4.57.F02.1.454.CMB.2.raw
  modified_base (364)..(364): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcgagggactccccgtgacgcgtattccctctggcctccaactcgtgggacncggccaccctgaccatcagcagggtcgaaggccggggatggaggccgattacttactgtcgaggtgtaggggataggtagtggtagatcgattccattaccgtcgttacggaacttcgggaccaggtctccgtacctacgtcacgcccaaggccaactccactcgtcacttcc

SEQ ID NO: 433241 - DNA, 536 bp, Homo sapiens
  misc_feature: GZ8MTXP02GYEY5.4.57.F02.1.454.CMB.2.raw
  modified_base (297)..(297): a, c, t, g, unknown or other
  modified_base (437)..(437): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggagtaaagtgtacattggtacaggcagaagccaggccaggccccctgtggtggtcgtccgttangatagcgaccggcctcagggatccctgagcgattcctctggctcaactctgggaccacggccacctgaccatcagcaggtcgaagccggggatgacgccgactatactgtcgaggtgtagggataggtagtgggtagatnactcagtacgtcgttacggaacgtcgggaaccgtaaggtcctaccgtaccctacgtccgacgacccaaggccccaaactcccactcgtacactttcccg

SEQ ID NO: 433242 - DNA, 578 bp, Homo sapiens
  misc_feature: GZ8MTXP02GC9QN.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggcccgtcagggacgtccctgtagcgatctcgtcggctccactctggaaccacgccgaccctcgaccactcacgcagggtacgaacgacccggggagtggaggccgactattactacgtcaggtggtgggagtaggtagtgggtgagttacactacgactacgttacgttcgggtaacgtaggggaccgtaaaacggtccgtccgttaccgttaccgtcgaccgacccgacggacccaacccgacctacgtccacctcgtcgttcccctaccccc

SEQ ID NO: 433243 - DNA, 556 bp, Homo sapiens
  misc_feature: GZ8MTXP02HFY3J.4.57.F02.1.454.CMB.2.raw
  modified_base (432)..(432): a, c, t, g, unknown or other
  modified_base (447)..(447): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacagttggtacaggcagaagccaggccaggcccctggtggtggtcgtcgttatgatagcgaccggcctcgagggactccctgacgcgtattctcgtcggcctccaactcgtagggaaccacggcccacctgaccatcgagcgaggggtcgaaggccggggatggacggccgatatacgtgtcgaggtgngggataggtagtggngagtcatccattacgtcttacggaacgtgggaacctaaggtcctaccgtccgtacgtcgacgacccaaggccccaacccgctcgtaccacgtcctccgttcccctcccc

SEQ ID NO: 433244 - DNA, 541 bp, Homo sapiens
  misc_feature: GZ8MTXP02JSTX1.4.57.F02.1.454.CMB.2.raw
  modified_base (355)..(355): a, c, t, g, unknown or other
  modified_base (416)..(416): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtcgttatgatagcgaccggccctcgagggatcccgtgagcgattctctcggctccaactctggggaaccncgggcccaccctgacccatcagcaggggtcgaagcccggggatggaggccgactattacgngtcaggtgtagggataggtgtggtgagtcatccattacgtcttacggaactgggaccaaggtctccggtcctacgtcacgcccaaggcccaaccccactcgtccacttcctcgttccccgtcccc

SEQ ID NO: 433245 - DNA, 517 bp, Homo sapiens
  misc_feature: GZ8MTXP02GQDHX.4.57.F02.1.454.CMB.2.raw
  modified_base (364)..(364): a, c, t, g, unknown or other
tcagagcactgtagcacgaccggtgctcgatttagctcgatatagttgggtttggggaagaggaagactgacggtcctcccaggtgtccagtgtcaggtgcacctggtggagtcgggggaggcgtggtccagcctgggggtccctgagactctcctgtgcagcgtctggattcgccttcagtgcctatggcatgcactgggtccgccaggctccaggcaaggggctggaatgggtgcagttatatggtttgatggaactaacaaattctatgcagactccgtgaaggccgattcacatctccagagacaatttcgagaacacattgaaatctacagatgaacagtctgagagccgagacacggntgtctattattgtgcgagagtaagtgtcatgtctttgacagtgggcagggacctggtcacgtctcctcagctccacaacgggccactccggtcttcccctcggccgccctcgcctccgaggaacgccacctcgtcgggggccacgacgcccgg

SEQ ID NO: 433246 - DNA, 526 bp, Homo sapiens
  misc_feature: GZ8MTXP02JNCY0.4.57.F02.1.454.CMB.2.raw
tcagagcactgtagcacgaccggtgctcgatttagctcgatatagttgggtttggggaagaggaagactgacggtcctcccaggagttcaggtgctgggcaccgtgggcatggggaggcgtggtccagcctggggtccctgagactctcctgtgcagcgtctggattcgccttcagtgcctatggcatgcactgggtccgccaggctccaggcaaggggctggaatgggtggcagttatatggtttgatggaactaacaaattctatgcagattccgtgaaggccgattcaccatctccagagacaatttcgagaacacattgaaatctacagatgaacagtctgagagccgaggacacggctgtctattatgtgcgagagtaagtggtcatggtctttgaccagtgggcgaggaacctggtcaccgtctacctcacgcttccaccaacggcccactccggtccttccccgtcggccgccctcgccgtccgacgacgcaccgtcgtcgggggcacgacgcggcccg

SEQ ID NO: 433247 - DNA, 666 bp, Homo sapiens
  misc_feature: GZ8MTXP02JIKSI.4.57.F02.1.454.CMB.2.raw
  modified_base (448)..(448): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagagcaggccaggcccctgtggtggtcgtccgttatgatagcgaccggccctgagggactcccgtgagcgattccctctggcctaccaactcgtacgggaccacgggaccccaccctgaacccatccaggcgaggggtcgaaacgggcccgggggatcgggacgggcccgaacttaagttaccgngttacgaaggggttggtggggtaattagggtaggtggggtagtaactcgtagtacctaagttaccggttacgtttaccggggaaacgttcgggggaaccctaaagggttcccgttaccccgttacccgtaccgttacccgaaccggtacccccgaaaacgggaccccctaaacccggtacccctaaaccgtttccggtacccctaacgttttcccccg

SEQ ID NO: 433248 - DNA, 522 bp, Homo sapiens
  misc_feature: GZ8MTXP02HOG4K.4.57.F02.1.454.CMB.2.raw
  modified_base (496)..(496): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgtatgatagcgaccggccctcagggatccctgagcgattctctggctccaactctgggaacacggccacctgaccatcagcagggtcaagccggggatggaggccgactatactgtcaggtgtaggatagtagtggtgatcatccatacgtcttcggaactgggaaccaaggtctccgtcctacgtcacgacccaaggcccaaacccgntcgtccacgtcctcgtacccctaccc

SEQ ID NO: 433249 - DNA, 604 bp, Homo sapiens
  misc_feature: GZ8MTXP02GTCCJ.4.57.F02.1.454.CMB.2.raw
  modified_base (289)..(289): a, c, t, g, unknown or other
  modified_base (353)..(353): a, c, t, g, unknown or other
  modified_base (398)..(398): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaggtaaagtgtacattggtacaggcagaagccaggccaggccctgtggtggtcgtcgtangatagcgaccggcctcgagggactcccgtgagcgattctcgtggctccaactcgtagggaaccncggcccaccctgaccatcagcaggggtcgaaaggcccgggggtancggacggccgtacgttacttacgtggtacgagggtggtagggtaagttaggttaggtgggtagtactacgacgtaccgtagttacgttcgttacggaacgtcgggaaccgtacggtccgtacccgtaccgtacgtaccgaccgtaccccgaaccggacccctaacccgtacgtacgtaccaccttccgttacccgttcccccgccc

SEQ ID NO: 433250 - DNA, 581 bp, Homo sapiens
  misc_feature: GZ8MTXP02HJU4R.4.57.F02.1.454.CMB.2.raw
  modified_base (278)..(278): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaggtaaagtgtacattggtacaggcagaagccaggccaggcccctgnggtggtcgtccgttatgatagcgaccggccctcagggactcccgtgagcgattctctcggctccaactcgtgggaaccacggccaccctgaccatcagcgagggtcgaagcccggggatggaggccgactatactgtcgaggtgtggggattaggtaggttggtgagttcaagttccattacgttcgttacgggaacgtcggggaacctaacgggtcctaccggtcctacgtccgacgccccgaaacggcccccaaaccccgcgtacgtccctaacctccgtaccggtttccccctacccccg

SEQ ID NO: 433251 - DNA, 516 bp, Homo sapiens
  misc_feature: GZ8MTXP02I49IE.4.57.F02.1.454.CMB.2.raw
  modified_base (494)..(494): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccacccttagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggcctccaactctgggaacacggccaccctgaccatcagcagggtcgaagccggggatgaggccgatattactgtcaggtgtgggataggtagtggtgatcatccatacgtcttcggaactgggaccaaggtctccgtctacgtcacgcccaaggccaacccnctgtcactctcgtcccacctcc

SEQ ID NO: 433252 - DNA, 529 bp, Homo sapiens
  misc_feature: GZ8MTXP02HH0SJ.4.57.F02.1.454.CMB.2.raw
  modified_base (413)..(413): a, c, t, g, unknown or other
  modified_base (442)..(442): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcgagggatcccgtgagcgattcctctggctccaactcgtgggacacgggccaccctgacccatcagcagggtcgaaggccgggatgaggccgactatacngtcgaggtgtggggataggtagtgggtanagtcatccatacgtcgtacggaactcggggacctagggtacctccgtcctacgtcacgacccaaggccaactccgactcgtacactc

SEQ ID NO: 433253 - DNA, 565 bp, Homo sapiens
  misc_feature: GZ8MTXP02J2YGI.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccccgtgagcgattctctcggctccaactctgggaaccacgggccaccctgaccatcagcagggtcgaaaggcccggggatggacggccgacgtattacctgtaccgaggtgtgggataggtagtggtgatcgatccgaatacgtcgttcggaacgtggggacctaacggtcctccgtcctaacgtccacgacccccgaaaggccccaaacccccacgtcgtaccacctcctccgtttccccgcccccg

SEQ ID NO: 433254 - DNA, 554 bp, Homo sapiens
  misc_feature: GZ8MTXP02JJ9PB.4.57.F02.1.454.CMB.2.raw
  modified_base (296)..(296): a, c, t, g, unknown or other
  modified_base (361)..(361): a, c, t, g, unknown or other
  modified_base (461)..(461): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtcgttangatagcgaccggcctcgagggatccccgtgacgcgattcccgtctggctccaactcgtgggaccncggccaccctgaccatcagcgagggtcgaaggccggggataggacggcccgacgtaacgttaccgtgtacgagggttggtggggattaggtagtgggtanagttcataccattacgttcttacgggaactcgggacctaggtcctccgtctacgtcacgacccaaggcccaacgtccactcgtaccacttccg

SEQ ID NO: 433255 - DNA, 528 bp, Homo sapiens
  misc_feature: GZ8MTXP02IY5H6.4.57.F02.1.454.CMB.2.raw
  modified_base (291)..(291): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacggcaggataactgtgtggaaccagcatcggaaggtaaagtgtacattggtacaggcagaagccaggccaggcccctgtggtggtcgtcgttangatagcgaccggcctcgagggactcccgtgacgcgattctctcggcctccaactcgtaggaaccacggccaccctgaccatcaagcagggtcgaaggccggggatggaggccgactattactgtcaggtgtagggatagtagtgtgatcatccaatcgtctcggaactgggaccaaggtctccgtctacgtcacgacccaggacccaaacccgctacgtcactctcttaccccaccc

SEQ ID NO: 433256 - DNA, 536 bp, Homo sapiens
  misc_feature: GZ8MTXP02JFHBQ.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagagccaggccaggcccctgtggtggtcgtccgttatgatagcgacccggccctcgaggggactcccgtgagcgattctctcggctccaactctgggaaccacgggccaccttgaacatcagcagggtcgaagccggggatggaggccgactattactgtcagggtgtgggataggtagtggtgatcatccatacgtcttcggactgggaccaggtctccgtcctacgtcacgcccaaggcccaaacccgacgtcgtaccacgtcctcggttcccctcccc

SEQ ID NO: 433257 - DNA, 528 bp, Homo sapiens
  misc_feature: GZ8MTXP02IGYGJ.4.57.F02.1.454.CMB.2.raw
  modified_base (382)..(382): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaactaacaaattctatgcagactccgtgaaggccgattcaccatctccagagacaatttcgaagaacacattgaatctacagatgaaacagtctagagagccgaggacacggctgtctattattgtgngagagtaagtgtcatgttctttgaccagtgggcagggacctggtcaccgtctcctcagcttcacacggcccagtccggtccttccccgtcggccgtccctcgcctccgacgacgccgaccgtcgcgggggcaccgacgcggcccgg

SEQ ID NO: 433258 - DNA, 539 bp, Homo sapiens
  misc_feature: GZ8MTXP02HKL3G.4.57.F02.1.454.CMB.2.raw
  modified_base (207)..(207): a, c, t, g, unknown or other
tcagagcactgtagcacgaccggtgctcgatttagctcgatatagttgggtttgggggaagaggaagactgacggtcctcccaggtgtccagtgtcaggtgcacctggtggagtcggggggaggcgtggtccagcctgggggtccctgagactctcctgtgcagcgtctggattcgccttcagtgcctatggcatgcactgggtccnccaggctccaggcaaggggctggaatggggtggcagttatatggtttgatggaaactaacaaattcatgcagactccgtgaaggccatcaccatctccagagacaatttcgagaacacattgaaatctaacagatagaacagtctagagagccgaggacacggctgtctattatgtgcgagagtaagtggtcagtgttctttgaccgtaggtggggaccgagggaaccctggtaccaccgtctcctcagccttccaccgaacggcccagtccgtccttccccgtcgccgccctcgcctccgaggaacgcaccgtcgtcggggcacgcgccgg

SEQ ID NO: 433259 - DNA, 544 bp, Homo sapiens
  misc_feature: GZ8MTXP02IEOQR.4.57.F02.1.454.CMB.2.raw
  modified_base (228)..(228): a, c, t, g, unknown or other
  modified_base (363)..(363): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcagtcggaggtaaaagtgtacattggtacaggcagaagccaggccaggcccctgtggtggtcgtccgttatgatagcgaccggccctcgaggggactcccgtgagcgattcctctggctccaactcgtgggacnccggcacccgtgacccatcagcgagggtcgaaaggccggggaatgacgggccgactagtactgtcgaggtgtgggattagtagtggtgatcatccatacgtcgttacggaactcgggacctaagggtccttaccgaccttacggccagccccaaggccaactccacgtcgtaccacttccg

SEQ ID NO: 433260 - DNA, 574 bp, Homo sapiens
  misc_feature: GZ8MTXP02GEWZ0.4.57.F02.1.454.CMB.2.raw
  modified_base (462)..(462): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcacgtgggtccgccaggctccaggcaaggggctgggaatggggtggcagttatagtggtttgatggaactaacaaattctatgcagactccgtgaaggccattcaccatctccagagacaatttcgagaacacattgaaatctaacagatagaaacagtactgaagagccgaggacacggctgtactattattgtgcgagagtaagtgtcagttggtctttgaccgtaggtcgggccgagggaaccctggtctaccgtctcctnacgtccttaccaccgaacggccctacgtccggttcccttcccccgtcggcccgtccctcgtccgtccgacggaacgccgtaccgtcggtcgggggaccaacggcggcccggg

SEQ ID NO: 433261 - DNA, 537 bp, Homo sapiens
  misc_feature: GZ8MTXP02GJSVZ.4.57.F02.1.454.CMB.2.raw
  modified_base (223)..(223): a, c, t, g, unknown or other
  modified_base (355)..(355): a, c, t, g, unknown or other
  modified_base (415)..(415): a, c, t, g, unknown or other
  modified_base (442)..(442): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaggtaaagtgtacattggtacaggcagagccaggccaggcccctgtggtggtcgtccgtatgatagcgaccggccctcgagggatccctgagcgattcctctcggcctccaactcgtggggaacncgggcccaccctgaccatcagcagggtcgaaggccggggatggacggccgactattacgngtcgaggtgtagggataggtagtggtnagtcatccatacgtcttcggaactgggaacctaggtcctccgtcctacgtcacgccccaaggcccaacccgctcgccactcctcgtcccgtcccc

SEQ ID NO: 433262 - DNA, 630 bp, Homo sapiens
  misc_feature: GZ8MTXP02HWWOR.4.57.F02.1.454.CMB.2.raw
  modified_base (204)..(204): a, c, t, g, unknown or other
tcagagcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaaggggctggaatgggtggcagttatatggtttgatggaactaacaaattctatgcagactccgtgaaggccgattcaccatctccagagacaatttcgaagaacacattgaatctaacagatgaaacagtctagagacgcgagacacgctgtactattattgtgcgagagtagtgtctagtgtcttttagaccgtaggtcggggaccgaacggggaacccgttgggtacctacccggttccttcccgtcgtacggtaccctttacccgaacccgaaaccggggtacccctaacgttcccgggttcccctttcccccccggttcgggccccgtccccgtccggtcccgtacccgaacggaccgcccgaacccgttccggtacgggggaccaaccggacggtcccggccccggg

SEQ ID NO: 433263 - DNA, 668 bp, Homo sapiens
  misc_feature: GZ8MTXP02IDVI7.4.57.F02.1.454.CMB.2.raw
  modified_base (223)..(223): a, c, t, g, unknown or other
  modified_base (356)..(356): a, c, t, g, unknown or other
  modified_base (379)..(379): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctcagtgtcagtggccccaggggcagacggccaggataacctgtgtggaaccngcatcggaaggtaaagtgtacattggacaggcagaagccaggccaggcccctgtggtggtcgtcgttatgatagcgaccggccctcgagggatcccgtgacgcgattctctggcctccaactcgtgggaaccnccgtcgaccctcgaccgactacncgacgacggtacgggacggaaccggggaccggtaggacgggaccggaccgttaacgtttaacgtacgtacggtacggtagggttgggtaggttagtaaggttagggtggtagtactacgtactaacgtacggttacgtttaccggtaacggtacgggtaaccggtaaaccggtacggttcccggtacccttaaccggtaccgtaccgacccggtaacccgaacccggaacccccgtaaacccctacgttacccgtacctacccggttccgttaccccgttaaccccccc

SEQ ID NO: 433264 - DNA, 519 bp, Homo sapiens
  misc_feature: GZ8MTXP02IXUM0.4.57.F02.1.454.CMB.2.raw
  modified_base (378)..(378): a, c, t, g, unknown or other
  modified_base (391)..(391): a, c, t, g, unknown or other
  modified_base (430)..(430): a, c, t, g, unknown or other
tcagagcactgtagcacgaccggtgctcgatttagctcgatatagttgggtttgggggaagaggaagactgacggtcctcccaggagttcaggtgctgggcaccgtgggcatggggaggcgtggtccagcctgggggtccctgagactctcctgtgcagcgtctggattcgccttcagtgcctatggcatgcactgggtccgccaggctccaggcaaggggctggaatgggtggcagttatatggtttgatgaaactaaacaaattctatgcagactccgtgaaggccgattcaccatctccagagacaatttcgagaacacattgaatctacagatgaacagtcagagagccgaggacacggctgtctattatgtgngagagtaagtgtnatgtctttgacagtgggcaggacctggtcaccgtctccncacgcttccacaaggcccatccggtccttccccgtggcccgccctcgcctccgaggacgccaccgtcgcgggggccacgacgcggcccg

SEQ ID NO: 433265 - DNA, 519 bp, Homo sapiens
  misc_feature: GZ8MTXP02JKNLB.4.57.F02.1.454.CMB.2.raw
  modified_base (357)..(357): a, c, t, g, unknown or other
  modified_base (410)..(410): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggccccctgtggtggtcgtccgttatgatagcgaccggccctcagggatcccgtgagcgattcctctggctccaactctgggacncggccaccctgaccatcagcagggtcgaagccggggatgagccgactattacngtcaggtgtggggatagtagtgggtgagtcatccatacgtcttcggaactcgggaccagggtctaccggtcctacgtcacgcccaaggccaacgtccactcgtccactc

SEQ ID NO: 433266 - DNA, 666 bp, Homo sapiens
  misc_feature: GZ8MTXP02F7TGK.4.57.F02.1.454.CMB.2.raw
  modified_base (300)..(300): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagaagccaggccaggcccctgtggtggtcgtcgttangatagcgaccggcctcgagggactccctgacgcgtattccctcgtggctacccaaacttccgtaggggaccaccgggcccacccgtgacccatccagcgaggggtacgaaacggcccggggatggacgggcccgtaacgttaacgttacgtgtccgaaggggttggtaggggtagttagggttaggtggggttagaacttacgattcccgaagttaccggttccgtttacgggaaaccgttcgggggaaaaccccgtaaacgggttcccgtaccccggttacccgttaccggtaccgaaccggaacccccgaaacgggtaccccctaaaaccgttccccgaaccttcggtaccctacctttccccg

SEQ ID NO: 433267 - DNA, 583 bp, Homo sapiens
  misc_feature: GZ8MTXP02IW2X7.4.57.F02.1.454.CMB.2.raw
  modified_base (301)..(301): a, c, t, g, unknown or other
  modified_base (367)..(367): a, c, t, g, unknown or other
  modified_base (427)..(427): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacagttggtacaggcaagaagccaggccaggcccctgtggtgtcgtcgttangatagcgaccggccctgagggactcccgtgacgcgtattcctctggcctccaactcgtagggaccncggcccaccctgacccatcagcgagggtcgaaggccggggatgacggccgactattacgngtctagggtgtgggataggtagtgggtagattcagtcccaagttaccgttacgttacgggaaacgttcggggaacctaagggtccttacccgtaccgtacggtaccacggaccccaaacggacccaaacctcccgaacgtcgtcctaactttcccg

SEQ ID NO: 433268 - DNA, 545 bp, Homo sapiens
  misc_feature: GZ8MTXP02JPQSI.4.57.F02.1.454.CMB.2.raw
  modified_base (354)..(354): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctggtggtggtcgtccgtatgatagcgaccggcctgagggactccctgagcgattctctcggctccaactctgggaacncggccaccctgaccatcagcagggtcgaaggccggggatggacggccgatagttactgtacagggtgtaggggataggtaggtggtgagtcatccattacgtcgttacggaaactgggaaccaagggttcctccggtacctacgtcacgacccaaggcccaaacccgctcgcacctctacgtcccctaccc

SEQ ID NO: 433269 - DNA, 510 bp, Homo sapiens
  misc_feature: GZ8MTXP02F8GFY.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgacggccctcagggatccctgagcgattcctctggctccaactctgggacacggccaccctgaccatcagcagggtcgaagccggggatgaggccgatatactgtcaggtgtgggatagtagtggtgatcatccatacgtcttcggaactgggaccaaggtctccgtctacgtcacgcccaaggccaactccgactcgtcacttcc

SEQ ID NO: 433270 - DNA, 505 bp, Homo sapiens
  misc_feature: GZ8MTXP02JG336.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcgagggactccctgagcgattccctctggctccaactctgggacatggccacctgaccatcagcagggtcgaagccggggatgaggccgagtattactgtcgaggtgtgggataggtaggtggtgatcgatccatacgtctcggaactgggacaggtctcgtctacgtcagccgagccactcactcgtctac

SEQ ID NO: 433271 - DNA, 526 bp, Homo sapiens
  misc_feature: GZ8MTXP02ITRX1.4.57.F02.1.454.CMB.2.raw
tcagagcactgtagcacgaccggtgctcgatttagctcgatatagttgggtttggggaagaggaagactgacggtcctcccaggagttcaggtgctgggcaccgtgggcatggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctccagagacaaatttcgagaacacattgaatctacagatgaacagtctgagagccgagggacacggctgtctattattgtgcgagagtaagtgtcatggtctttgaccagtgggcaggaacctggtcaccgtctcctcacgcttccacacgggcccagtccggtccttcccctggccgcccgtcgcctccacggacgccgaccgtcgtcgggggcacgcggccggcccg

SEQ ID NO: 433272 - DNA, 534 bp, Homo sapiens
  misc_feature: GZ8MTXP02F7WFO.4.57.F02.1.454.CMB.2.raw
  modified_base (484)..(484): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtctctgagactctcctgtgcagcgtctggattcgccttcagtgcctatggcatgcactgggtccgccaggctccaggcaaggggctggaatgggtgcagttatatggtttgatggaactaacaaattctatgcagactccgtgaagggccattcaccatctccagagacaattcgagaacacattagaatctacagatgaaacagtctgagagccgaggacacggctgtccattatgtgcgagagtaagtgtcatgtctttgaccagtcgggcacgggaaccctggtcaccgtctcctcacgcttccaccgaacgggccctagtccggtccttcccccgnggccgccctcgcctccgaaggacgccaccgtcggtcgggggcacgaccgg

SEQ ID NO: 433273 - DNA, 571 bp, Homo sapiens
  misc_feature: GZ8MTXP02F30C2.4.57.F02.1.454.CMB.2.raw
  modified_base (543)..(543): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagagcaggccaggcccctgtggtggtcgtccgtactgatagcgaccggcccgtcaggagtcctgagcgatctctcggctccactctggacacgccaccctcgacactcagacgacgggtcgaaggacccggggagtagaggaccgactagttactcgtcgaggtgtggggtagtaggtagtgggtcgtagtcactaccgtatacggtcttacgggtaacgtacggggaccgtaaacggtcgtccgtcctacggttaccgacgacccgaacgacccgaacccctaaccncggtacacctcgtcgttcccctaccccg

SEQ ID NO: 433274 - DNA, 613 bp, Homo sapiens
  misc_feature: GZ8MTXP02HNGE2.4.57.F02.1.454.CMB.2.raw
  modified_base (215)..(215): a, c, t, g, unknown or other
  modified_base (587)..(587): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacggcaggataacctgtgnggaacagcagtcggaaggtaaaagtgtaacagttggtacaggcaagaacgccaggccaggcccctggtggtggtccgtccgttatgataggcgacccggccctcgagggactccccgtgacgcgtattccgtcgtcggcctaccactcgtacgggaaccaccgggcccacccgtagacccactacgacgcgtaggggtaccgaagggcccggggaatcgggacggcccgaacttacgttacgtgtacgaggtggtagggagttaggtaggttggtagattcacgtaccgagtaccgttcgttacggaacgtcgggaacctaacgggtccttaccgtccgtacgtccacgacccgaacggccccaaacccgtntacgtcactcctccgtaccctacccc

SEQ ID NO: 433275 - DNA, 572 bp, Homo sapiens
  misc_feature: GZ8MTXP02JC12S.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagagccaggccaggcccctgtggtggtcgtccgttatgatagcgaccggccctcgagggactcccgtgacgcgattctctcggctccgaactcgtagggaacacggccaccctgaccatcagcagggtcgaaggccggggatggaggccgatatactgtcaggtgtgggataggtagtggtgagtcagtcagtacgtcgttacggaacgtcgggaacctaacgggttccctaccggtacctacgtaccgaccgaccccgaaacgggccccaaaccccgacgttcgtaccctactccgttccgtccccgtaccccc

SEQ ID NO: 433276 - DNA, 545 bp, Homo sapiens
  misc_feature: GZ8MTXP02HU2PY.4.57.F02.1.454.CMB.2.raw
  modified_base (517)..(517): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaaggtaaaagtgtacattggtacaggcagaagccaggccaggcccctgtggtggtcgtcgttatgatagcgaccggccctcgagggactcccgtgagcgattctcgtcggcctcccaactcgtagggaaccacgggcccaccctgaccatcagcagggcgaagccggggatgaggccgatattacgtgtcgaggtgtagggataggtagtggtgatcatccatacgtcttacggaactgggacctaacggtctccgtcctacgtcacgcccaaggcccaaacccgntcgtcacctctaccgtttccccaccccc

SEQ ID NO: 433277 - DNA, 579 bp, Homo sapiens
  misc_feature: GZ8MTXP02IJ84W.4.57.F02.1.454.CMB.2.raw
  modified_base (363)..(363): a, c, t, g, unknown or other
  modified_base (444)..(444): a, c, t, g, unknown or other
  modified_base (471)..(471): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagatggccaggataacctgtgtgggaaccagcagtcggaaggtaaagtgtacagttggacaggcagaagccaggccaggcccctgtggtgtcgtccgttatgatagcgaccggccctgagggactccgtgacgcgtattcgtcctggcctaccaactcgtagggaaaccnccgggcccaaccctgaacccatccgaagccgaggggtccgaaacggcccgggggatcggaacgggcccgaactacttacgngtcgagggtggtgggataggtagtggngagtcatccagtacgtcgttacggaacgtcgggaccacggttcctcccgtacctacggtcacgacccaacggcccaaacccgctacgacctacgtctaccgtaccccc

SEQ ID NO: 433278 - DNA, 517 bp, Homo sapiens
  misc_feature: GZ8MTXP02HTB6K.4.57.F02.1.454.CMB.2.raw
  modified_base (227)..(227): a, c, t, g, unknown or other
  modified_base (436)..(436): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaggtaaagtgtacattggtacaggcagaagccaggccaggcccctgtggtggtcgtccgttatgatagcgaccggcctcagggactccctgacgcgattcctctggctccaactccgtgggaccacggcccaccctgaccatcagcagggtcgaagccggggatgaggccgatatactgtcgaggtgtggatagtagtggtnatcatcatacgtctacggactcgggactaaggtcctccgtctacgtcacgaccaacggccaactccactcgactacttccg

SEQ ID NO: 433279 - DNA, 608 bp, Homo sapiens
  misc_feature: GZ8MTXP02GULSK.4.57.F02.1.454.CMB.2.raw
  modified_base (566)..(566): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccatcaccatctcagagacaatttcgagaacacattgaatctaacagatcgaacagtctagagacgccgaggacacggctgtctattattgtgcgagagtaagtgtcagttggttctttgaccgtaggtcggggacccgaacggggtaaaccctgggttacacccggttccgtaccctccgaacgtccctttacccgaaacccgtaaacggggtccccctaagttcccgggttccctttcccccgtggtccccgtcccgtcgccctacccgacggtaccnccgtacccgtcggtcgggggaccacgacggcccggtccccgg

SEQ ID NO: 433280 - DNA, 529 bp, Homo sapiens
  misc_feature: GZ8MTXP02GNZMH.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctccagagacaatttcgagaacacattgaatctacagatgaacagtctgagagcgaggacacggctgtctattatgtgcgagagtaagtgtcatgtctttgacagtgggcaggacctggtcaccgtctcctcacgcttccaccaagggcccacgtccggtccttcccccgtggcccgccctcgcctccgaggacgccgtaccgtcgtcgggggcacgacggccggtcccgg

SEQ ID NO: 433281 - DNA, 524 bp, Homo sapiens
  misc_feature: GZ8MTXP02IK7SU.4.57.F02.1.454.CMB.2.raw
  modified_base (295)..(295): a, c, t, g, unknown or other
  modified_base (359)..(359): a, c, t, g, unknown or other
  modified_base (438)..(438): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggcaggataactgtgtgggaaccagcatcggaggtaaagtgtacattggtacaggcagaagccaggccaggcccctgtggtggtcgtccgttangatagcgaccggccctgagggactccctgagcgattcctcgtggctaccaactcgtaggggacncggccaccctgaccatcagcagggtcgaagccggggatgaggccgactatactgtcaggtgtagggatagtagtgggtnatcgatccatacgtctacggaactcgggaccaaggtcctccgtcctacgtcacgcccaacggccaaactccactcgtacacgtccg

SEQ ID NO: 433282 - DNA, 532 bp, Homo sapiens
  misc_feature: GZ8MTXP02FT63R.4.57.F02.1.454.CMB.2.raw
  modified_base (333)..(333): a, c, t, g, unknown or other
  modified_base (474)..(474): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccattcacatctccagagacaatttcgagaacacattgaatctanagatagaacagtctagagagccgaggacacggctgtctattattgtgcgagagtaagtgtcatggttctttgaccagtgggaccagggaacctggtcaccgtctcctcagcttccacacggccagtccggtccttccccgnggccgccctcgcctaccgacggacgccgaccgtcggtcggggcacgcggccggcccgg

SEQ ID NO: 433283 - DNA, 519 bp, Homo sapiens
  misc_feature: GZ8MTXP02IZXQ4.4.57.F02.1.454.CMB.2.raw
  modified_base (297)..(297): a, c, t, g, unknown or other
  modified_base (356)..(356): a, c, t, g, unknown or other
  modified_base (413)..(413): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagagccaggccaggcccctgtggtggtcgtccgttangatagcgaccggccctcagggatcccctgagcgattcctctggctccaactctgggacncggccaccctgacccatcagcagggtcgaagccggggatggaggcccgactattacngtcagggtgtgggataggtagtgggtgatgatccatcgtcttcggaactgggaccaagggtctccgtctacgtcacgcccaaggcccaactccactcgtcacttcc

SEQ ID NO: 433284 - DNA, 531 bp, Homo sapiens
  misc_feature: GZ8MTXP02JFY1W.4.57.F02.1.454.CMB.2.raw
  modified_base (292)..(292): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacatggtacaggcagaagccaggccaggcccctgtggtggtcgtccgttangatagcgaccggcctcagggatcccctgacgcgattctctcggctccaactctgggaacacggccacctgaccatcagcagggtcgaagccggggatggacggccgactagtactgtcaggtgtagggataggtagtggtgatcgatccatacgtctacggaactgggaacctaaggtctccgtacctacgtcacgacccaaggcccaacccactcgtaccactctacggtccctcccc

SEQ ID NO: 433285 - DNA, 528 bp, Homo sapiens
  misc_feature: GZ8MTXP02G60VR.4.57.F02.1.454.CMB.2.raw
  modified_base (350)..(350): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtcgtatgatagcgaccggcctcgagggactccctgagcgattctctggctccaactctgggaacncggccaccctgaccatcagcgagggtcgaaggccggggatggacggccgactatactgtcagggtgtgggataggtagtggtgatcagtccatcgtcttacgggaactgggacctaaggtcctaccgtcctacgtcacgcccaaggcccaacccgctcgtcactctcgtccctacccc

SEQ ID NO: 433286 - DNA, 539 bp, Homo sapiens
  misc_feature: GZ8MTXP02F3M6C.4.57.F02.1.454.CMB.2.raw
  modified_base (323)..(323): a, c, t, g, unknown or other
  modified_base (410)..(410): a, c, t, g, unknown or other
  modified_base (490)..(490): a, c, t, g, unknown or other
  modified_base (521)..(521): a, c, t, g, unknown or other
  modified_base (526)..(526): a, c, t, g, unknown or other
  modified_base (537)..(537): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggccctggtggtggtcgtcgtatgatagcgaccggcctgagggatccctggancgattctctcggcctccaaactcgtacgggaaaccaccgggcccaccctgacccatccagcgaggggtacgaaaggcccgggggaanggaggcccgtaatattactgtgagggtgtaggggatagtagtgtagatcatccatacgtcttacggaatggacaaggtcnccgtactacgcacgcccaagcccaaacccgntcgcnctctcgtcccncc

SEQ ID NO: 433287 - DNA, 531 bp, Homo sapiens
  misc_feature: GZ8MTXP02GAHK3.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcgaggggactccccgtgagcgattccctctggctccaactcgtgggacacggcccacctgacccatcagcgaggggtcgaaggccggggatggacggccgactattactagtcagggtgtgggatagtagtggtagatcatccgatacgtctacggaactcgggacaggtctccgtcctacgtcacgcccaaggcccaacgtccactcgtacactcc

SEQ ID NO: 433288 - DNA, 503 bp, Homo sapiens
  misc_feature: GZ8MTXP02GKO9H.4.57.F02.1.454.CMB.2.raw
  modified_base (444)..(444): a, c, t, g, unknown or other
  modified_base (467)..(467): a, c, t, g, unknown or other
  modified_base (470)..(470): a, c, t, g, unknown or other
  modified_base (477)..(477): a, c, t, g, unknown or other
  modified_base (482)..(482): a, c, t, g, unknown or other
  modified_base (486)..(486): a, c, t, g, unknown or other
  modified_base (489)..(489): a, c, t, g, unknown or other
  modified_base (496)..(496): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccattcaccatctccagagacaattcgagaacacattagaatctaacagatacgaaacagtctagagagccgaggaccacggctgtactattattgtgcgagagtaagtggtcatggtcctttgaccagtgggacagggaacctggtcacgtctcncagctcacagccatcgtctcccngcncctcgcncagancacncgngggcacncgcgccg

SEQ ID NO: 433289 - DNA, 541 bp, Homo sapiens
  misc_feature: GZ8MTXP02JT8P4.4.57.F02.1.454.CMB.2.raw
  modified_base (345)..(345): a, c, t, g, unknown or other
tcagagcactgtagcacgaccggtgctcgatttagctcgatatagttgggttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccattcaccatctccagagacaattcgagaacacattgaatctacagatgaacagtctgagagccgaggacacggctgtctattattgtgcgagagtaagtggtcatggtctttgcngtggggcagggacctgtcaccgtctcctcacgcttccaccgaagggcccactccggtccttcccccgtcggcccgccctcgcctccgacggacgccacccgtcgtcgggggccacgacggccggcccgtgggcctcgccgtggtccaacggacctaccgttccctacgagtcgctcgtgacggcgggcgtcggacg

SEQ ID NO: 433290 - DNA, 508 bp, Homo sapiens
  misc_feature: GZ8MTXP02J3ATK.4.57.F02.1.454.CMB.2.raw
  modified_base (227)..(227): a, c, t, g, unknown or other
  modified_base (244)..(244): a, c, t, g, unknown or other
  modified_base (338)..(338): a, c, t, g, unknown or other
  modified_base (396)..(396): a, c, t, g, unknown or other
  modified_base (425)..(425): a, c, t, g, unknown or other
  modified_base (432)..(432): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaggtaaaagngtacatggtacaggcagaagccaggccaggccccctgtggtggtcgtccgttatgatagcgaccggccctcaggggatcccctgagcgattccnctggctccaactctgggacacggccaccctgaccatcagcagggtcgaagccggggangaggccgactattactgtcaggtgtgggntagtagnggtgatcatccatacgtcttcgaactgggacaggtctccgtcctacgtcagcccaagccaactccactcgtcactc

SEQ ID NO: 433291 - DNA, 594 bp, Homo sapiens
  misc_feature: GZ8MTXP02GIU7Q.4.57.F02.1.454.CMB.2.raw
  modified_base (366)..(366): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaaagtgtacattggacaggcagagcagccaggcccctgtgtggtcgtcgtatgatagcgaccggcctcgagggactccccgtgacgcgtattccctcgtcggcctaccaacttcgtacgggaccnccgggcccaacccgtcgaccatccagcgagggtacgaaacggccggggatggacggccgacttagtactgtacgagggtggaggggtattaggtaggttagggtgaattcgattacctagttaccgtacgttacggaacgttcgggggaaccctaaaggggttccctacccgttaccgtaccgtaccacgacccgaaggcccaaactccgactcgtacctacttcccg

SEQ ID NO: 433292 - DNA, 515 bp, Homo sapiens
  misc_feature: GZ8MTXP02GQJ14.4.57.F02.1.454.CMB.2.raw
  modified_base (355)..(355): a, c, t, g, unknown or other
  modified_base (410)..(410): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattcctctggctccaactctgggacncggccaccctgaccatcagcagggtcgaaggccggggatggaggccgatattacngtcagggtgtgggataggtagtgggtgatcagtccatacgtcttcggaactcgggaccaggtctccgtctacgtcacgcccaaggccaactccactcgtcactcc

SEQ ID NO: 433293 - DNA, 580 bp, Homo sapiens
  misc_feature: GZ8MTXP02FPNB7.4.57.F02.1.454.CMB.2.raw
  modified_base (420)..(420): a, c, t, g, unknown or other
  modified_base (431)..(431): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaagtgtacattggtacaggcagaagccaggccaggcccctgtggtggtcgtccgttatgatagcgaccggccctcgaggggatccccgtgagcgattcctctggctccaactcgtgggacacggccacccgtgaccatcagcgagggtcgaagccggggatgacggccgactattacgngtcgaggtggngggagtagtaggtgggtagagtcaagtcctaagtaccgttacgttacgggtaaacgtcggggaaccgaaagggttccgtcccgtaccgttaccggtaccaacgaccccgaaacggcccaaaccgtcccaccgttcgacctactttcccg

SEQ ID NO: 433294 - DNA, 711 bp, Homo sapiens
  misc_feature: GZ8MTXP02GXQL8.4.57.F02.1.454.CMB.2.raw
  modified_base (229)..(229): a, c, t, g, unknown or other
  modified_base (262)..(262): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagcggtggtttcgcgtaggctctttaagaggtgtccagtgtcaggtgcacctggtggagtcgggggaggcgtggtccgngccgtgggggtcccgtgagactctcctgtgcgngcgtcgtggtgtcgtccttcgagtcgtcctatgcatgcgacgtcgggtccgccgacggccgtccgacggacggaacggggcggtaggtaaggtggggtggtacgtaggttagttagttggtttgtagtaaggtaaacgtaaacttaaacttactagtacgtacgtacgtaccgtaccggtacgggtaacgggtaccgtacgttaccgtaaccctacgtacctaccgaacgtaacgtaacgtaaacgttaacgtaacgtaaacgtaaactaacgttaacgtaacttaactaactaacgtaacgtaacgtaacgtaacgtacgtaggacggaacggacggaacggaaccggtacggtacgttacgttacgttaacgtttacgtttacgttaggtacggtaaggtaaggttaaggttacggttacgtacggtttacggtttaccggtttacg

SEQ ID NO: 433295 - DNA, 554 bp, Homo sapiens
  misc_feature: GZ8MTXP02GJNJU.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaagtgtacattggtacaggcagaagccaggccaggcccctgtggtggtcgtccgttatgatagcgaccggccctcgagggatcccgtgagcgattctctcggcctccaaactctaggggaaccacgggcccaccctgacccatcagcagggtcgaaggccggggagtcgaggcccgtagtattacgtgtcgaggtgtgggataggtagtggtgagtcatccaatacgtcgttcggaacgtgggaaccaagggtctaccggtctacgtcgacgacccaacggcccaaacccgctcgtaccactctccgttccctcccc

SEQ ID NO: 433296 - DNA, 593 bp, Homo sapiens
  misc_feature: GZ8MTXP02GA1T2.4.57.F02.1.454.CMB.2.raw
  modified_base (250)..(250): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggcctccaggcaaggggctggaatgggtgcagttatatggttnatggaactaacaaattctatgcagactccgtgaaggccattcaccatctccagagacaatttcgagaacacattagaaatctacagatgaaacagtctagagagcgaggacacggctgtctaattattgtgacgagagtaagtggtctagtggttccttttgaccgtaggtggggaccaggggaaccctgggtaccaccgttcgtcctacgacgtccttacccgaaccgtaacgggcccctaacgtcccggttcccgtttccccccgttgggcccgtccccgttcgcccgtaccgacggacgccgtacccgtcggtcgggggaccacgacggccggtccccgg

SEQ ID NO: 433297 - DNA, 544 bp, Homo sapiens
  misc_feature: GZ8MTXP02JUKUY.4.57.F02.1.454.CMB.2.raw
  modified_base (365)..(365): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcgagggactccctgacgcgattccctcgtggctccaactcgtgggaccncgggcccaccctgaccatcagcgaggggtcgaaggccgggggatggacggccgactagttactgtcgagggtggtgggataggtagtgggtgattcatccattacgtcgttacggaattcggggaacctaggtcctccgtctacgtcacgcccaagcccaactccactcgacacttccg

SEQ ID NO: 433298 - DNA, 554 bp, Homo sapiens
  misc_feature: GZ8MTXP02JDVRL.4.57.F02.1.454.CMB.2.raw
  modified_base (293)..(293): a, c, t, g, unknown or other
  modified_base (552)..(552): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagagccaggccaggcccctgtggtggtcgtccgttangatagcgaccggcctcgagggactcccgtgacgcgattctctcggcctccaactcgtacgggaaccacgggccaccctggaccatcagcaggggtcgaaaggccggggatggaggccgatattacgtgtcgaggtgtagggataggtagtggtgagtcatccaagttacgtcgttacggacgtcgggaacctaaggtcctccggtactacgtcacgacccgaaggcccaacccgtctcgtaccactcctcgttcccccncc

SEQ ID NO: 433299 - DNA, 588 bp, Homo sapiens
  misc_feature: GZ8MTXP02IJ298.4.57.F02.1.454.CMB.2.raw
  modified_base (349)..(349): a, c, t, g, unknown or other
tcagagcactgtagcacgaccggtgctcgatttagctcgatatagttgggttgggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaattcgagaacacattgaatctacagatgaacagtctgagagccgaggacacggctgtctattatgtgcgagagtaagtgtcagtggttccttttgaccnggtcggggaccaggggtaaccctgggtccaccgttctccctcacgtcttccaccgaacgggcccaagttccggtcccttccccccgtggcccgccccttcggcccttccgagggacgccgacccgtcgtcgggggaccacgcggccggcccgtgggcttcgacgttgggacctaaagggaccttaccgttcccgtacgacggttcgccttcgtacggacggccgggcgttcggaaccgg

SEQ ID NO: 433300 - DNA, 568 bp, Homo sapiens
  misc_feature: GZ8MTXP02GL6QP.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggagtaaagtgtacattggtacaggcagaagccaggccaggcccctgtggtggtctccgttatgatagcgaccggacccgtcagggatccctgagcgagttctctcggctccactctggaaccgacggcccaccctcgaccactcagcgagggtacgaacgcccggggagtaggacggccggactattaacgtgtcaggtgtggagtagtaggtggttggatcacgtccatacgtcgttcggaacgtcgggaccaaacggtccgtccgtcctaaccgtcgaccgacccgaacggacccaaccccaaccgtcgtaccacctcctacgttcccctaaccccc

SEQ ID NO: 433301 - DNA, 545 bp, Homo sapiens
  misc_feature: GZ8MTXP02H1UHC.4.57.F02.1.454.CMB.2.raw
  modified_base (293)..(293): a, c, t, g, unknown or other
  modified_base (309)..(309): a, c, t, g, unknown or other
  modified_base (351)..(351): a, c, t, g, unknown or other
  modified_base (410)..(410): a, c, t, g, unknown or other
  modified_base (519)..(519): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaggtaaagtgtacattggtacagtcagaagccaggccaggcccctgtggtggtcgtcgttangatagcgaccggcctnagggatccctgagcgattctctggcctccaactctgggaacncggcccaccctgacccatcagcgagggtcgaaaggccggggatggaggcccgatattcngtcaggtgtgggatggtagtggtagatcagtccagttacgtcttacggaacttcggggaacctaacgggtcttcccgtacctacgtcacgcccaaacggcccaaacccntacgtcaccttctcgttccccacccc

SEQ ID NO: 433302 - DNA, 518 bp, Homo sapiens
  misc_feature: GZ8MTXP02HJRXZ.4.57.F02.1.454.CMB.2.raw
  modified_base (463)..(463): a, c, t, g, unknown or other
tcagagcactgtagcacgaccggtgctcgatttagctcgatatagttgggtttgggggaagaggaagactgacggtcctcccaggagttcaggtgctgggcaccgtgggcatggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccattcaccatctccagagacaatttcgagaacacattgaatctacagatgaacagtctgagagccgaggacacggctgtctatattgtgcgagagtaagtgtcatgtctttgaccagtgggccagggaacctggtcacgtctcctcagcttccacaacggccatcggtcttccccgnggccgccctcgcctccgacggacgccgaccgtcgtcggggcacgcgccggtcccg

SEQ ID NO: 433303 - DNA, 512 bp, Homo sapiens
  misc_feature: GZ8MTXP02HTB6R.4.57.F02.1.454.CMB.2.raw
  modified_base (415)..(415): a, c, t, g, unknown or other
  modified_base (424)..(424): a, c, t, g, unknown or other
  modified_base (435)..(435): a, c, t, g, unknown or other
  modified_base (504)..(504): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaaagtgtacattggtacaggcagaagccaggccaggcccctgtggtggtcgtccgttatgataggcgaccggccctcgagggactccctgagcgattcctctggctaccaactctagggaccaccggccacctgacccatcagcgaggtcgaagccgggatgagccgatatacngtcaggtgnggattagtagnggtacgatcatcagtactctacgacgtggaccaaggtctccgtctcgcacgccaagccaactccactcnctactccg

SEQ ID NO: 433304 - DNA, 535 bp, Homo sapiens
  misc_feature: GZ8MTXP02GTDZR.4.57.F02.1.454.CMB.2.raw
  modified_base (357)..(357): a, c, t, g, unknown or other
  modified_base (415)..(415): a, c, t, g, unknown or other
  modified_base (444)..(444): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccagcatcggaaggtaaagtgtacattggtacaggcagaagccaggccaggcccctgtggtggtcgtccgtatgatagcgaccggccctcgagggatcccctgagcgattcctctggctccaactctgggacncggccaccctgaccatcagcgagggtcgaaggccggggatggaggcccgatattacgngtcaggtgtaggggattaggtagtgggtnatcgatcattacgtcttcggaacgttcgggacgtaaggtcctaccgtcctacgtcacgcccaaggcccaacgtcccactcgtccacttccg

SEQ ID NO: 433305 - DNA, 550 bp, Homo sapiens
  misc_feature: GZ8MTXP02HJHVH.4.57.F02.1.454.CMB.2.raw
  modified_base (300)..(300): a, c, t, g, unknown or other
  modified_base (425)..(425): a, c, t, g, unknown or other
  modified_base (453)..(453): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagaagccaggccaggcccctgtggtggtcgtcgttangatagcgaccggccctcgagggactcccgtgagcgtattcctcgtggctccaacttcgtaggggaccaccgggccacccgtgaccatcagcagggtcgaagccggggatgacggccgatattacngtacagggtgtagggattagtaggtggngatcgatccatacgtcgttacggaacgtcgggaacctagggtcctccggtcctacgtcacgcccaaacggcccaacgtccacgtcgtcctacttccc

SEQ ID NO: 433306 - DNA, 506 bp, Homo sapiens
  misc_feature: GZ8MTXP02FWE75.4.57.F02.1.454.CMB.2.raw
  modified_base (470)..(470): a, c, t, g, unknown or other
  modified_base (483)..(483): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctaatgcagactccgtgaaggccgattcaccatctcagagacaatttcgagaacacattgaaatctacagatacgaacagtctagagagccgaggacacggctgtctatttatgtgacgagagtaagtgtcatgtctttgacagtgggcaggacctggcacgtctctcagcttccacgaacggccagtcgtctcccctgccncctgcctcgagcncgactcgcgggcacgacgcgccg

SEQ ID NO: 433307 - DNA, 540 bp, Homo sapiens
  misc_feature: GZ8MTXP02HCK9H.4.57.F02.1.454.CMB.2.raw
  modified_base (365)..(365): a, c, t, g, unknown or other
  modified_base (469)..(469): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcgagggactcccgtgagcgattccctcgtggctccaactcgtagggaccncgggccaccctgacccatcagcgagggtccgaaagccgggggatggaggccgactattacgtgtcgaggtgtgggatagtaggtggtgatcagtccataccgtntacggaacgtcggggacctaaggtcctaccggtcctacgtcacgcccaaggccaactccactctcacttcc

SEQ ID NO: 433308 - DNA, 691 bp, Homo sapiens
  misc_feature: GZ8MTXP02ID8I0.4.57.F02.1.454.CMB.2.raw
  modified_base (227)..(227): a, c, t, g, unknown or other
  modified_base (298)..(298): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaggtaaaagtgtacattggtacaggcagaagccaggccaggcccctgtggtggtcgtccgttangatagcgaccggccctcgagggactccccgtgacgcgattccctcgtcggctccaaactccgtacggggaccaccgggcccaccccgtacgaacccacgtcacgaccgaggggccgaaaagggcccgggggaaatcgggaaacgggcccggtaacttaacgttaaccgtggtccgaaaggggttggtagggggtaagttaagggttaaggttggggttaggaagtacccgtaagtacccctaagtttaaccggttccgtttaccggggaaaccgttcgggggaaacccctaaaggggttcccttacccggtaccgttaaccggttccgaaccgacccccgaaaacgggcccctaaaacccgtccctaacttccggtaacctaccgtttccccg

SEQ ID NO: 433309 - DNA, 588 bp, Homo sapiens
  misc_feature: GZ8MTXP02G4EG0.4.57.F02.1.454.CMB.2.raw
  modified_base (386)..(386): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaaactaacaaattctatgcagactccgtgaaggccattcaccatctcagagacaattcgagaacacattgaaatctaacagatagaaacagtctgagagccgaggacacggctgtctattatgtgngagagtaagtgtacagtggttcctttgaccgtaggttcggggccgtaacggggaaccctgggtcctaccggtcctccgtcacgtccttcccgaaccgaacgggtcccctaacgtcccggttcccttcccccgtcggtcccgtccctcgtccctcccgaaggaaccgccgaccgttcggcgggggaccaaccgcggccccggg

SEQ ID NO: 433310 - DNA, 513 bp, Homo sapiens
  misc_feature: GZ8MTXP02F0FJK.4.57.F02.1.454.CMB.2.raw
  modified_base (356)..(356): a, c, t, g, unknown or other
  modified_base (405)..(405): a, c, t, g, unknown or other
  modified_base (428)..(428): a, c, t, g, unknown or other
  modified_base (432)..(432): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggccccctgtggtggtcgtccgttatgatagcgaccggccctcagggatccctgagcgattcctctggctcaactctgggacncggcacctgaccatcagcagggtcgaagccgggatgaggccgatatacngtcaggtgtgggatagtgtggtnagtnatccaatcgtcttacgggaactgggaccaagggtctaccgtctacgtcacgcccaaaggccaactccactcgtccacttcc

SEQ ID NO: 433311 - DNA, 538 bp, Homo sapiens
  misc_feature: GZ8MTXP02F9I23.4.57.F02.1.454.CMB.2.raw
  modified_base (355)..(355): a, c, t, g, unknown or other
  modified_base (392)..(392): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcgagggatccctgacgcgattctctcgctccaactctgggaaccncggccacctgaccatcagcagggtcgaagccggggangaggccgactattacgtgtcaggtgtagggataggtagtggtagatcagtccatacgtcgttacggaactcgggaacctaaggtcctccgtcctacgtcacgacccaaggcccaacccgacgtcgtaccactctcggttccctccc

SEQ ID NO: 433312 - DNA, 529 bp, Homo sapiens
  misc_feature: GZ8MTXP02F5NR2.4.57.F02.1.454.CMB.2.raw
  modified_base (307)..(307): a, c, t, g, unknown or other
  modified_base (350)..(350): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggccctgtggtggtcgtcgttatgatagcgaccggccctnagggactccctgagcgattctctggctccaactctgggaaccncggccaccctgaccatcagcagggtcgaagccggggatggacggccgactattactgtcaggtgtgggatagtagtggtgatcatcattacgtcttggaactggggacctaaggtcctccgtcctacgtcacgacccaacggcccaaaccccgctacgccacgtctcgttccccacccc

SEQ ID NO: 433313 - DNA, 513 bp, Homo sapiens
  misc_feature: GZ8MTXP02JAW6D.4.57.F02.1.454.CMB.2.raw
  modified_base (432)..(432): a, c, t, g, unknown or other
  modified_base (490)..(490): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagagccaggccaggcccctgtggtggtcgtccgttatgatagcgaccggccctcagggactccctgagcgattctctcggctccaactctggggaaccacggccacctgaccatcagcagggtcgaagccggggatgaggccgactatactgcaggtgtgggatagtagtggtgatnatccatacgtctcggaatggaccaggtctcgtctacgtcacgacccaggcccaacccnctcgtcacgtctcgtccctaccc

SEQ ID NO: 433314 - DNA, 525 bp, Homo sapiens
  misc_feature: GZ8MTXP02FNL1U.4.57.F02.1.454.CMB.2.raw
  modified_base (407)..(407): a, c, t, g, unknown or other
  modified_base (437)..(437): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtcgttatgatagcgaccggcctcagggatccctgagcgattcctctggctccaactcgtagggacacggccaccctgaccatcagcagggtcaagccgggatgaggccgactatacngtcaggtgtgggataggtagtggtagactnatccatacgtcttacggaactggggaccaaagggtcctccgtcctacgtacacgacccaaaggcccaaactccactcgtccacttccg

SEQ ID NO: 433315 - DNA, 552 bp, Homo sapiens
  misc_feature: GZ8MTXP02HG084.4.57.F02.1.454.CMB.2.raw
  modified_base (363)..(363): a, c, t, g, unknown or other
tcagagcactgtagcacgaccggtgctcgattagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaactaacaaattctatgcagactcgtgaagggccattcaccatctccagagacaatttcgagaacacattgaatctacagatgaacagtctagagagccgaggacacggntgtctattatgtgcgagagtaagtggtctatcggttcttttgacctaggtcggggaccacggggtaaccctggtcaccgtctcctcacgcttccacgacgggcccacgtccggtccttcccccgtggcccgcccttcgcctccgacggacgccgtaccgtcgtacgggggcaccgacggccggtcccgg

SEQ ID NO: 433316 - DNA, 538 bp, Homo sapiens
  misc_feature: GZ8MTXP02IV8QY.4.57.F02.1.454.CMB.2.raw
  modified_base (355)..(355): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattcctctggctccaactcgtgggacncggccaccctgaccatcagcgagggtcgaaaggccgggggatggacggcccgatattacgtgtcgagggtggtagggattaggtaggtggtagagtcaatccaagtacgtcgttcggaactggggacctaaggtcctaccgtcctacgtcacgacccaaggccaactccactcgtcacttccg

SEQ ID NO: 433317 - DNA, 790 bp, Homo sapiens
  misc_feature: GZ8MTXP02GHOEL.4.57.F02.1.454.CMB.2.raw
  modified_base (263)..(263): a, c, t, g, unknown or other
  modified_base (288)..(288): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggaggcgtggtccagcctggggggtccctgagacctctcgtgtcacgngtcgtcgtagtcgtccgtcctacgngtccgtactaggtcgactagtcgactacgggtccgggtcccgacggacgtcctaccggacgacgggacgggtcgtaggtagggtggggtcgagttaagttataggtttggtagtagtacggtaaactaaattaacttctagtcgacgtaacgtcccgtacggtaaggggacccgggtaccttacttacccaactactccctaacgaagacgtaaactttaacgttacgggaaaactaaccaaatttaggtaaacgtaacctttacgtaaacgaaagttacgtaaaacccgaaaggttacgttacggtaagggaaaggacccgggtaaacccgggggaaaggaaacccgggtaacccggtttcggttaaaccggtttaactttaaaacgttttcgggtttacggggtacccggaaagggtaaacgggttaaaacgggtttaagggggttcccgtaacgtttaaggggtttccccggtttttttaccgtttaaaaccccggggg

SEQ ID NO: 433318 - DNA, 532 bp, Homo sapiens
  misc_feature: GZ8MTXP02GWB3R.4.57.F02.1.454.CMB.2.raw
  modified_base (227)..(227): a, c, t, g, unknown or other
  modified_base (422)..(422): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaaggtaaagtgtacattggtacaggcagaagccaggccaggcccctgtggtggtcgtccgttatgatagcgaccggccctcgaggggactccccgtgagcgattccctctggctccaactcgtcgggaccaccggccaccctgaccatcagcagggtcgaaggccggggatggaggccgactattacngtcgaggtggtgggatagtagtggtgagtcatcatcgtctcggaacgtcgggaccaaggtcctccgtcctacgtcacgcccaaggcccaacgtccacgtcgtcacttccg

SEQ ID NO: 433319 - DNA, 530 bp, Homo sapiens
  misc_feature: GZ8MTXP02F11VC.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggttgatggaactaacaaattctatgcagactccgtgaaggccattcacatctccagagacaatttcgagaacacattgaatctacagatgaacagtctgagagcgaggacacggctgtctattatgtgcgagagtaagtgtcagtgttctttgaccagtgggaccgaggaacctggtcaccgtctcctcacgcttccacgacggcccacgtccggtccttccccgtggcccgtccctcgcctaccgagacgccgaccgtcgtcgggggcacgacgcggtcccgg

SEQ ID NO: 433320 - DNA, 538 bp, Homo sapiens
  misc_feature: GZ8MTXP02FUTV0.4.57.F02.1.454.CMB.2.raw
  modified_base (446)..(446): a, c, t, g, unknown or other
  modified_base (513)..(513): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagagccaggccaggcccctgtggtggtcgtcgtatgatagcgaccggccctcgaggggactcccgtgacgcgattctctcggctccaactctggggaaccacgggccaccctgaccatcagcagggtcgaaggccggggatggaggccgactattactgtcagggtgtagggataggtaggtggtgagtnactcatacgtcttcggaactggggaccaaggtcctccgtctacgtcacgacccaaggcccaaccccnctcgtccacgtcctcgttccctacc

SEQ ID NO: 433321 - DNA, 512 bp, Homo sapiens
  misc_feature: GZ8MTXP02FO1BH.4.57.F02.1.454.CMB.2.raw
  modified_base (367)..(367): a, c, t, g, unknown or other
  modified_base (423)..(423): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatgggtgcagttatatggtttgatggaactaacaaattctatgcagactccgtgaaggccgattcaccatctccagagacaatttcgagaacacattgaaatctaacagatagaaacagtctgagagccgaggacacggntgtctattatgtgcgagagtagtgtcatgttctttgcagtgggcgaggacctgtcncgtctcctcagcttcacacggccagtcgtccttccctcggccgccctcgcctccgagacgcgaccgtcgtcggggcacgacgcggtccg

SEQ ID NO: 433322 - DNA, 540 bp, Homo sapiens
  misc_feature: GZ8MTXP02HSSP5.4.57.F02.1.454.CMB.2.raw
  modified_base (228)..(228): a, c, t, g, unknown or other
  modified_base (278)..(278): a, c, t, g, unknown or other
  modified_base (290)..(290): a, c, t, g, unknown or other
  modified_base (329)..(329): a, c, t, g, unknown or other
  modified_base (402)..(402): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcagtcggaggtaaaagtgtacatggtacaggcagagcaggcagccctgnggtgtctcgtangatagcgaccggcctcgagggatcccctgagcgattccnctggctccaatctgggacacggccaccctgaccatcacgcagggtcgaagcggggatgaggcccgatatacgngtcaggtgtgggataggtagtggtgatcatccaattacgtcttacggaacgtcggaacccgtaaagggttcctcccggttacctacggtaccacgacccgaaaggcccaaaactcccaagtcgtacctacctttcccg

SEQ ID NO: 433323 - DNA, 522 bp, Homo sapiens
  misc_feature: GZ8MTXP02JWJZ6.4.57.F02.1.454.CMB.2.raw
  modified_base (492)..(492): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggaggcgtggtccagcctggggggtccctgagactctcctgtgcagcgtctggattcgccttcagtgcctatggcatgcacgtgggtccgccaggcctccaggcaaggggctgggaatggggtgcagttatagtgggtttgataggaactaacaattctatgcagactccgtgaacgggcgattcacatctccagacgacaatttcgagaacacattagaatctacagatagaacagtctagagagaccgaggacgacggctgtctattacttgtgngaagagtaagtggtcagtcggtctttacgg

SEQ ID NO: 433324 - DNA, 535 bp, Homo sapiens
  misc_feature: GZ8MTXP02G5N6C.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaaggtaaagtgtacattggtacaggcagaagccaggccaggcccctgtggtggtcgtccgttatgatagcgaccggccctcgagggatcccctgagcgattcctctggctccaactctgggacacggccaccctgaccatcagcagggtcgaagccggggatggaggccgatattactgtcaggtgtgggatagtagtggtgatcagtccatacgtcttacggaacgttcgggacctaagggtcctccggtacctacgtcacgcccaaaggcccaaactcccgtactcgtaccacttccc

SEQ ID NO: 433325 - DNA, 579 bp, Homo sapiens
  misc_feature: GZ8MTXP02IMN6W.4.57.F02.1.454.CMB.2.raw
tcagagcactgtagcacgaccggtgctcgatttagctcgatatagttgggtttgggggaagaggaagactgacggtcctcccaggtgtccagtgtcaggtgcacctggtggagtcggggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccattcaccatctccagagacaatttcgagaacacattgaatctaacagatgaacagtctgagagccgagacacggctgtctattatgtgcgagagtaagtgtctagtggtctttgaccaggtcggggccagggaacccgtggtaccaccgtcctcccgtcacgtcttaccgaccgtaaacgggccccaagttccggtcctttcccccgtcgggcccgccctcggacccttccgaacggtaacgcccgtaacccgttccggtacgggggccaaccgtacggccccggg

SEQ ID NO: 433326 - DNA, 532 bp, Homo sapiens
  misc_feature: GZ8MTXP02JCS8I.4.57.F02.1.454.CMB.2.raw
  modified_base (312)..(312): a, c, t, g, unknown or other
  modified_base (333)..(333): a, c, t, g, unknown or other
  modified_base (353)..(353): a, c, t, g, unknown or other
  modified_base (479)..(479): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggagtaaagtgtacatggtacaggcagaagccaggccaggcccctgtggtggtcgtccgttatgatagcgaccggccctnagggatccctgagcgattccnctggctccaactctgggacncggccaccctgaccatcagcagggtcgaagccggggatgacgccgactatacgtgtcagggtgtggggattagtaggtggtgagtcagtccatacgtcttacggaacttcggggaccaaggttccnccgtcctacgtcacgcccaaacggccaaacctcccaacgtcgtaccacttccg

SEQ ID NO: 433327 - DNA, 569 bp, Homo sapiens
  misc_feature: GZ8MTXP02IO9YE.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaaagtgtacattggtacaggcagaagccaggccaggcccctgtggtgtcgtccgttatgatagcgaccggcctcgagggactccctgacgcgtattctctcggcctccaactcgtagggaaccacgggcccaccctgacccatcagcgaggggtcgaaggccggggatggacggccgattattacgtgtacgaggtgtagggattaggtagttggtgagtacgatccgtaagtacgtcgttacggacgtcgggaacctaaggtcctaccgtcctacgtcgacgacccgaacggcccaacccgactcgtaccactcctccgttccccgtcccc

SEQ ID NO: 433328 - DNA, 528 bp, Homo sapiens
  misc_feature: GZ8MTXP02I1XJ0.4.57.F02.1.454.CMB.2.raw
  modified_base (362)..(362): a, c, t, g, unknown or other
  modified_base (419)..(419): a, c, t, g, unknown or other
  modified_base (446)..(446): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaggtaaaagtgtacattggtacaggcagaagccaggccaggcccctggtggtggtcgtccgttatgatagcgaccggcctcgagggatccccgtgagcgattccctctggctccaactcgtgggacncgggccaccctgaccatcagcgagggtcgaagccgggggatggaggccgatactacngtcaggtgtgggattaggtagtgggtnagtcatccatacgtctcggaactgggaccaaggtctaccgtctacgtcacgacccaaggccaactccactcgtactacttcg

SEQ ID NO: 433329 - DNA, 519 bp, Homo sapiens
  misc_feature: GZ8MTXP02H06P1.4.57.F02.1.454.CMB.2.raw
  modified_base (405)..(405): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaggtaaaagtgtacattggacaggcagaagcaggccaggcccctgtggtggtcgtcgtatgatagcgaccggccctcgagggatcctgagcgattctctggctccaactcgtaggggaaccacggccaccctgaccatcagcagggtcgaagccggggatgaggccgatattacngtcaggtgtggggataggtagtgtgatcatccatacgtcttacggactgggaccaaggtctacgtcctacgtcacgcccaaggccaacccgactgtcactcctcgttcccaccc

SEQ ID NO: 433330 - DNA, 581 bp, Homo sapiens
  misc_feature: GZ8MTXP02HC6YC.4.57.F02.1.454.CMB.2.raw
  modified_base (300)..(300): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagaagccaggccaggcccctgtggtggtcgtcgttangatagcgaccggccctgagggactcccgtgacgcgattccctctggcctaccaacgtccgtaggggaccaccgggcccaacccgtcgaaccactcgacgcgaacgggggtccgaaacgggccgggggaatcgggacgggaccgaacttacgttaaccgtgtacgaggggtggttaggggattagggagtgggtagatcatccattacgtcgttacggaactgggaaccaggtcctaccgtctacgcacgaccgaacggcccaactccagtctacacttccg

SEQ ID NO: 433331 - DNA, 531 bp, Homo sapiens
  misc_feature: GZ8MTXP02IKTDY.4.57.F02.1.454.CMB.2.raw
  modified_base (362)..(362): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcgagggactccctgacgcgattcctctggctccaactcgtagggacncggccaccctgacccatcagcagggcgaaggccggggatggacggccgactagttacgtgtcagggtgtgggattagtgtggtgatcgatcagtcgtactcggaactcgggactaaggtctccgacctacgtcacgaccaaggcccaacgtccacgtcgtacacttccg

SEQ ID NO: 433332 - DNA, 509 bp, Homo sapiens
  misc_feature: GZ8MTXP02JJKIK.4.57.F02.1.454.CMB.2.raw
  modified_base (348)..(348): a, c, t, g, unknown or other
  modified_base (354)..(354): a, c, t, g, unknown or other
  modified_base (429)..(429): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggacaggcagaagccaggccaggcccctgtggtggtcgtccgttatgatagcgaccggccctcagggatccctgagcgattcctctggctcaactcngggacncggccaccctgaccatcagcagggtcgaagccgggatgaggccactatactgtcaggtgtgggatagtagtggtnagtcagtccatacgtcttacggactgggacaaggtctccgtctgccgtcacgcccaaggcccaacgtccacgtcgctacc

SEQ ID NO: 433333 - DNA, 534 bp, Homo sapiens
  misc_feature: GZ8MTXP02HUDRN.4.57.F02.1.454.CMB.2.raw
  modified_base (229)..(229): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccngcatcggaaggtaaaagtgtacattggtacaggcagaagccaggccaggcccctgtggtggtcgtccgttatgatagcgaccggccctcgagggactccctgagcgattcctctggctccaactctagggacacggccaccctgacccatcagcagggtcgaagccggggatggaggccgatatactgtcaggtgtagggataggtagtgggtgatcatccatacgtcttcggaactcgggacctaagggtcctccggtcctacgtcacgacccaaggtcccaactccaactcgactaccttccg

SEQ ID NO: 433334 - DNA, 535 bp, Homo sapiens
  misc_feature: GZ8MTXP02IX0EO.4.57.F02.1.454.CMB.2.raw
  modified_base (360)..(360): a, c, t, g, unknown or other
  modified_base (420)..(420): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcgagggatcccctgagcgattcctctggctccaactcgtgggacnccggccaccctgaccatcagcgagggtcgaaggccgggggatggaggccgatacttacgngtcgaggtgtagggatagtagtggtgatcgatcatacgtctacggaactcggggaccaaggtcctccgtaccgtacgtcacgacccgaaggcccaacgtccactcgtcacttccg

SEQ ID NO: 433335 - DNA, 563 bp, Homo sapiens
  misc_feature: GZ8MTXP02FYM73.4.57.F02.1.454.CMB.2.raw
  modified_base (358)..(358): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacatggtacaggcagaagccaggccaggcccctgtggtggtcgtccgttatgatagcgaccggcctcgagggactcccgtgacgcgattctctcggcctccaactctaggggaaccncgggcccacctgaccatcagccaggggtcgaaaggcccgggggatcggacgggcccgagtacttacgtgtcgaggtgtgggataggtaggtggtgatcactccatacgtcgttacggaacgtggggacctaagggtcctccggtacctacgtcacgacccaacggaccccaacccgactcgtacccactccgtcgttccccgccc

SEQ ID NO: 433336 - DNA, 573 bp, Homo sapiens
  misc_feature: GZ8MTXP02IZA04.4.57.F02.1.454.CMB.2.raw
  modified_base (306)..(306): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggaggtcgggggaggcgtggtccagccgtgggggtccctgagactctcctgtgcagcgtctggattcgccttcagtgcctatggcatgcacgtgggtccncaggctccgaggcgaaggggctagggaatggggtgcagttatagtggttgatggaaactaacaaattctatgcagactcggtagaacgggccgattccacatctcagagaactaagttcgagaacactaattagaaacttctaacagaactagaaacctagtctagagacgaccggaaggacgacgggtctacggtacttaatttacgtggtgacggtaaggtaggttaaaggtcggtacgtaagtttcggtttaccttttaacggg

SEQ ID NO: 433337 - DNA, 559 bp, Homo sapiens
  misc_feature: GZ8MTXP02IZT0M.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaggtaaagtgtacattggtacaggcagaagccaggccaggcccctgtggtggtcgtccgtatgatagcgacccggcctcgagggactcccgtgagcgattctctggctccaactcgtgggaaccacggccacctgaccatcagcagggtcgaacggccggggatggacggcccgattacttactggtacgaggtgtaggggataggtaggttggtgatcgatcccgtatcgtcgtacggaacgtgggacctaaggtccctccggtacctacggtccacgacccaacggcccaaaccccgcgtcgtccactccgtcccttccctacccc

SEQ ID NO: 433338 - DNA, 530 bp, Homo sapiens
  misc_feature: GZ8MTXP02H5SSG.4.57.F02.1.454.CMB.2.raw
  modified_base (173)..(173): a, c, t, g, unknown or other
  modified_base (327)..(327): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctnagtgtcagtggccccaggggcagacggccaggataacctgtgtgggaaccagcatcggaaggtaaaagtgtacattggtacaggcagagcaggccaggccctgtggtgtcgtcgtatgatagcgaccggcctcgagggatccctgagcgattcnctggcctcaactcgtggaacacgggccacctgaccatcagcagggtcgaagccggggatggacggccgactatacgtgtcgaggtgtgggtataggtagtggagatcgatccatacgtcgttcgaacgtgggaacctaggtacctccgtcctacgtcacgaccaacggccaaccccgatcgtacactccgtcgttccccgccc

SEQ ID NO: 433339 - DNA, 500 bp, Homo sapiens
  misc_feature: GZ8MTXP02F8T4N.4.57.F02.1.454.CMB.2.raw
  modified_base (403)..(403): a, c, t, g, unknown or other
tcagagcactgtagcacgaccggtgctcgatttagctcgatatagttgggtttgggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattcctctggctccaactctgggacacggccaccctgaccatcagcagggtcagccggggatgaggcgatatangtcaggtgtgggatagtagtggtgatcgatccatacgtcttggaactgggaccaaggtctcgcctacgtcagcccaaggccaactccactgtcactc

SEQ ID NO: 433340 - DNA, 577 bp, Homo sapiens
  misc_feature: GZ8MTXP02HOFSA.4.57.F02.1.454.CMB.2.raw
tcagagcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctgggaatgggtggcagttatagtggtttgatggaactaacaaattctatgcagactccgtgaaggccattcaccatctccagagacaatttcgagaacacattgaatctacagatgaacagtctagagacgccgaggacacggctgtactattatgtgacgagagtaagtggtcagttggttctttgaccgtaggtcgggccgacggggaaccctgggtaccaccggttctcctcgacgtccttaccgaccgtaacgggccctacgttcccggtccttcccccgttggcccgtcccgttcgcctcccgacggacgcccgaccgttcggcgggggccacggacgcccggcccgg

SEQ ID NO: 433341 - DNA, 521 bp, Homo sapiens
  misc_feature: GZ8MTXP02IR1K7.4.57.F02.1.454.CMB.2.raw
  modified_base (360)..(360): a, c, t, g, unknown or other
  modified_base (415)..(415): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacatggtacaggcagaagccaggccaggcccctgtggtggtcgtccgttatgatagcgaccggccctcgagggactccccgtgagcgattccctctggctccaactctcgggacncggcccaccctgacccatcagcgagggtcgaagcggggatgagcccgaatatacngtcaggtgtgggatagtagtggtgatcatccatcgtctcgaactgggactaaggtctaccgtcctacgtcacgacccaaggcccaaactccactcgtccacgttcc

SEQ ID NO: 433342 - DNA, 580 bp, Homo sapiens
  misc_feature: GZ8MTXP02G1T0J.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccatcaccatctcagagacaatttcgaagaacacattagaatctacagatcgaaacagtctagagagcgaggacacggctgtctattatgtgacgagagtaagtgtcagttcgtctttcgaactaggtcggggtaccgacgggtaacccgtcgggtaccaccgttcctcccgtcgacgtccttacccaccgaacggggacccctacgttccggtcccgttcccccgtggcccgtcccgtcgcctaccgacggacgccgtacccgtcgtacgggggacaccgacgccggtcccg

SEQ ID NO: 433343 - DNA, 549 bp, Homo sapiens
  misc_feature: GZ8MTXP02IF8VJ.4.57.F02.1.454.CMB.2.raw
  modified_base (435)..(435): a, c, t, g, unknown or other
  modified_base (491)..(491): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggaggtcgggggaggcgtggtccagccgtgggggtccctgagactctcctgtgcagcgtctggattcgcctcagtgcctatggcatgcacgtgggtccgccaggcctccgaggcgaaggggctggaatggggtgctagttatagttggtttagagtaggaaactaacaaatttctatgcagacctcggtagaacgggcctatcaccatctacagacgactaattcgaanacaacattagaatctacagtatagaactagtctaggagagaccgaaggacacggtntacgttataagtttgtcgtagcgaagtagtagtcggtatacggtcgtttactttacgg

SEQ ID NO: 433344 - DNA, 682 bp, Homo sapiens
  misc_feature: GZ8MTXP02GOVTK.4.57.F02.1.454.CMB.2.raw
  modified_base (274)..(274): a, c, t, g, unknown or other
  modified_base (287)..(287): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagagcaggcagccctgnggtgtcgtcgtangatgcgaccggcctcgagggactcccgtggacgcgtattcctcgtcggcctccgaactcgtagggaaaccacgggcccacccgtgaaccctatccgagcgacggggtacgaaacggcccgggggaatcggggacgggacccgaacgttacgttaccgtggtacgaggggttgggtagggggtattaagggtaggttgggtagagttaccaagttcccgtaagttaccggttaccgtttaaccggggaaacgttacgggggaacccttaaaaggggttccccttacccggttacccgttaacggtcccgaaaccggacccccaaacggggaccccctaaaaccccgtcgtaccggttaccaacccggttccttcccggtttaccccctaacccccg

SEQ ID NO: 433345 - DNA, 569 bp, Homo sapiens
  misc_feature: GZ8MTXP02JUT1B.4.57.F02.1.454.CMB.2.raw
  modified_base (250)..(250): a, c, t, g, unknown or other
  modified_base (295)..(295): a, c, t, g, unknown or other
  modified_base (310)..(310): a, c, t, g, unknown or other
  modified_base (314)..(314): a, c, t, g, unknown or other
  modified_base (463)..(463): a, c, t, g, unknown or other
  modified_base (522)..(522): a, c, t, g, unknown or other
  modified_base (535)..(535): a, c, t, g, unknown or other
  modified_base (541)..(541): a, c, t, g, unknown or other
  modified_base (543)..(543): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccggcctggggggtccctgagactctcctgtgcagcgtctggattcgccttcagtgcctatggcatgcactgggtccgccaggctccaggcaaggggctggaatgggtgcagttatatggtttnatggaactaacaaattcatgcagactcgtgaaggccatcacatcncagagacatttcganaacncattgaatctaacagatgaaccagtctaggacacgcccggaaggtaccacgggcttgtactaatttattggtgacgaagtagtaaaggtggtcagttggttcctttaggaccgtaggtcggggaccgtaacggggaacccttgggtacnccgtctcccgttacacgtcttacccaccgaacggcccagttccggcttccccgtggccnccgtcgctaccgnggaccncncgtcggacggacacgtacgccgcgcg

SEQ ID NO: 433346 - DNA, 578 bp, Homo sapiens
  misc_feature: GZ8MTXP02GYLD0.4.57.F02.1.454.CMB.2.raw
  modified_base (359)..(359): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggactccctgagcgattcctctggctccaactcgtagggacncggccaccctgaccatcagcgagggtcgaaggccggggatggaggccgaactagtactgtcgaggtggtagggataggtaggtgggtagatctatcccgtaattaccggtcgtttacgggaaacgttcggggaaaccctaagggtccgtcccggttacctaccgtccaacggacccgaaacggcccaaaccgtcccgaacttcggtacccacgttcccg

SEQ ID NO: 433347 - DNA, 517 bp, Homo sapiens
  misc_feature: GZ8MTXP02JEH97.4.57.F02.1.454.CMB.2.raw
  modified_base (358)..(358): a, c, t, g, unknown or other
  modified_base (410)..(410): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcgagggatcccgtgagcgattcctctggctccaactctgggacncgaccaccctgaccatcagcagggtcgaagccggggatgagccgactatacngtcagggtgtgggattaggtagtgggtgatcatccatacgtctcggaactgggaccaaggtctccgtcctacgtccagcccaaggccaacgtccactcgtacacgtc

SEQ ID NO: 433348 - DNA, 564 bp, Homo sapiens
  misc_feature: GZ8MTXP02IW2WW.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccgaggcaaggggctggaatggggtgcagttatatggtttgatggaactaacaaattcatgcagactcgtgaaggccattcaccatctcagagacaattcgagaacacattgaatctacagatgaacagtctagagagaccgaggacacggctgtactattatgtgcgagagtaagtgtcatggtctttgacctagtgggaccagggaacctggtacaccgtcgtcctcacgtctccgaaccgaacgggccctaacgtccggttcccgttcccccgtcggtcccgcccttcggccctaccgacgggacgcccgacccgtcggtacgggggaccacggacggccggtcccgg

SEQ ID NO: 433349 - DNA, 624 bp, Homo sapiens
  misc_feature: GZ8MTXP02IAN5E.4.57.F02.1.454.CMB.2.raw
  modified_base (591)..(591): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtggaaccagcatcggaaggtaaagtgtacattggtacaggcagagccaggccaggcccctgtggtgtcgtcgttatgatagcgaccggcctcgagggactcccgtgacgcgtattcctcgtcggcctacccaactcgtaggggaaaccaccgggcccacccgtcgaacccatccgaggccgagggggtaccgaaacgggcccgggggaatcgggacgggcccgtaacgttagtttaacgtgtaccgagggttggtaggggattaggtaggtggttgatcagtccagttacgtcgttacggaacgtcggggaacctaagggttcctacccggtaccgttaaccggtcaccggaccccgaacggaccccaaacccccncgtacgtccacttccgttcgttcccccgtcccc

SEQ ID NO: 433350 - DNA, 514 bp, Homo sapiens
  misc_feature: GZ8MTXP02H8B0E.4.57.F02.1.454.CMB.2.raw
  modified_base (285)..(285): a, c, t, g, unknown or other
  modified_base (345)..(345): a, c, t, g, unknown or other
  modified_base (465)..(465): a, c, t, g, unknown or other
  modified_base (474)..(474): a, c, t, g, unknown or other
tcagagcactgtagcacgaccggtgctcgatttagctcgatatagttgggtttgggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactggtccgccaggctccaggcaaggggctggaatgggtggcagttatatggtttgatggaactaacaaattctatgcagactccgngaaggccgattcacatctccagagacatttcgagaacacattgaatctacagatgaaacngtctgagacgccgaggacacggctgtctattatgtgcgagagtaagtgtcagtgtctttgacagtgggccagggacctggtcacgtctctcagctcaccaggcccatccggtcttccccncgccgcccncgcctccaggaacgcaccgtcgtcggggcacgacgcccgg

SEQ ID NO: 433351 - DNA, 563 bp, Homo sapiens
  misc_feature: GZ8MTXP02GW1TA.4.57.F02.1.454.CMB.2.raw
  modified_base (223)..(223): a, c, t, g, unknown or other
  modified_base (353)..(353): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaaggtaaagtgtacattggtacaggcagagcaggccaggcccctgtggtggtcgtccgtatgatagcgaccggcctcgagggactcccgtgacgcgtatctctcggctccactcgtggaaccncggccaccctgaccatcagcaggggtcgagggccggggatcggaggccgatactactgtacgaggtgtagggattaggtagtggtgagtcatcagtacgttcttacggaacgtcgggaacctaacggtcctaccgtcccgttacgtaccacgacccccgaaaggcccccaaaccccgactccgtcaccttcctacgttccccctaacccc

SEQ ID NO: 433352 - DNA, 533 bp, Homo sapiens
  misc_feature: GZ8MTXP02IDSIZ.4.57.F02.1.454.CMB.2.raw
tcagagcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctccagagacaattcgagaacacattgaatctacagatagaacagtctgagagcgaggacacggctgtctatttatgtgcgagagtaagtgtcatgtcttttgacctggtcgggcacggggaaccctggtcaccgtcctcccgtcagtccttccaccgaaacgggcccagttccggtcccttcccccgtgccgtccctgcctccgaggacgcacctcgtggggcacgcggcgcccgtggctcgcctggcaaacggactacctcccgtacagtcgctctgcggcggtctcggcg

SEQ ID NO: 433353 - DNA, 595 bp, Homo sapiens
  misc_feature: GZ8MTXP02HTZ5O.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtcggcccagggcagacggcaggataacctgtgtggaaccagcatcggaaggtaaaagtgtacagttggacaggcagaagccaggccaggcccctgtggtgtacgtcgttactgagtagcgaccggccgtcgaggaactccgtcgagcgtactctcgtcgctccaactcgtggaacgacggcccacctacgaccactcgacgcgacgggacgaaacggccgggggagtacggacggacgaccgtaacttacgtcgtaccgtagggtggtagggagtaggtaggtggtgtagtcagtaccatacgtccgtacggtaacgtacggaaccgtacggtaccttccgtaccttacggacaccgacccgaacggaccccaacccgaaccgtcgtccaacttccgtccgttacccctaccccc

SEQ ID NO: 433354 - DNA, 639 bp, Homo sapiens
  misc_feature: GZ8MTXP02IYTXE.4.57.F02.1.454.CMB.2.raw
  modified_base (203)..(203): a, c, t, g, unknown or other
  modified_base (300)..(300): a, c, t, g, unknown or other
  modified_base (335)..(335): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccnccaggcctccaggcaaggggctggaatgggtggcagttatagttggtttgatggaactaaacaaattctatgcagactcgtgaaggccatcacatcncagagactaattcgaagaacactattgaaatctanagatagaacagtctagagacgccgagggaccacggcttagtacttaatttatgtgcgaagtagtaagtggtctagtcggttcctttagaccgtaggtacggggaccgtaacggggtaacccttcggtaccgtaccccgttcgtcccgtacgtaccggtccttacccgaaacccgtaaccgggacccctaacgttcccggttccctttcccccgcggtccccgtcccgttccggtccctacccggaacggaccgcccgtaaccccgttcggtccgggggaccaacccgtacggcccggtccccgg

SEQ ID NO: 433355 - DNA, 508 bp, Homo sapiens
  misc_feature: GZ8MTXP02HQFF7.4.57.F02.1.454.CMB.2.raw
  modified_base (387)..(387): a, c, t, g, unknown or other
  modified_base (400)..(400): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaggtaaaagtgtacatggtacaggcagaagcaggccaggcccctgtggtggtcgtcgttatgatagcgaccggcctcgagggatccctgagcgattcctctggctccaactctgggacacggccacctgaccatcagcgaggtcgaagcgggangagccgatatacngtcaggtgtggatagtagtggagatcatcatacgtctacggaactgggaccaaggtctccgtactacgtcacgacccgaaaggccaaactccaatcgtactacttccg

SEQ ID NO: 433356 - DNA, 519 bp, Homo sapiens
  misc_feature: GZ8MTXP02HW1Z6.4.57.F02.1.454.CMB.2.raw
  modified_base (357)..(357): a, c, t, g, unknown or other
  modified_base (432)..(432): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgacgcgattcctctggctccaactctgggacncggccaccctgaccatcagcagggtcgaagccggggatgaggccgatatactgtcaggtgtgggatagtagtggngatcatccatacgtctacggaactcgggaccaagggtcctccggtcctacggtcacgcccaaggcccaaactcccatcgtcacttcc

SEQ ID NO: 433357 - DNA, 520 bp, Homo sapiens
  misc_feature: GZ8MTXP02JHGVQ.4.57.F02.1.454.CMB.2.raw
  modified_base (295)..(295): a, c, t, g, unknown or other
  modified_base (316)..(316): a, c, t, g, unknown or other
  modified_base (329)..(329): a, c, t, g, unknown or other
  modified_base (348)..(348): a, c, t, g, unknown or other
  modified_base (358)..(358): a, c, t, g, unknown or other
  modified_base (417)..(417): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggccaggataacctgtgtgggaaccagcatcggaggtaaaagtgtacattggtacaggcagaagccaggccaggcccctgtggtgctccgtatgatagngaccggcctcaggagtccctnagcatctctcgcncacactcgacgacgcaccncacacacagngagacgagacggacgagagcgactactactagtgagtgtggtagtagtagtagtgaganacacactacgtacgtacgtacgtacgacgaacgtacgtccgtcctacgtacgacgaccgaaccgaccgaacccgaacctactactactactacttacctaccc

SEQ ID NO: 433358 - DNA, 632 bp, Homo sapiens
  misc_feature: GZ8MTXP02IE4M0.4.57.F02.1.454.CMB.2.raw
  modified_base (175)..(175): a, c, t, g, unknown or other
  modified_base (303)..(303): a, c, t, g, unknown or other
  modified_base (374)..(374): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccaccctnagtgtcaggtcggccccagggcagacggcaggataacctggtgtgggaaccagcagtcgggaaggtaaaagtgtaacagttggtacaggcagaagccaggccacggccctgtggtggtcgtccgttangatagcgaccggcctcgagggactcccgtgagcgtattctcgtcggcctacccaactcgtacggggaaccncccgggcccaccccgtgacccatccgaggcgacggggtacgaaacgggcccgggggatcgggacgggcccgtaacgttacgtttacgtggtacgagggtggtaggggaagttaggtaggtggtgatcgatccgagttacgtcgttacggaacgtacgggaaccgtaacggtccgttacccggtccttaccgtacaccgacccgaacggaccccaaaccccacgtacgtccaccttccttaccgtttacccccaccccc

SEQ ID NO: 433359 - DNA, 547 bp, Homo sapiens
  misc_feature: GZ8MTXP02JQXZK.4.57.F02.1.454.CMB.2.raw
  modified_base (296)..(296): a, c, t, g, unknown or other
  modified_base (362)..(362): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtacattggtacaggcagaagccaggccaggcccctgtggtggtcgtccgttangatagcgacccggcctcgagggactcccgtgacgcgattctctcggcctccaactcgtgggaaccncggccacctgaccatcagcgagggtcgaaggccggggatggaggccgatattactgcaggtgtagggatgtagtgtgatcatccagttacgtcgttacggaacgtcgggaacctaacggtcctccgtcctacgtcacgacccgaacggcccaacccacgtcgtccacgtcctcggtcccctcccc

SEQ ID NO: 433360 - DNA, 609 bp, Homo sapiens
  misc_feature: GZ8MTXP02F0GSY.4.57.F02.1.454.CMB.2.raw
  modified_base (223)..(223): a, c, t, g, unknown or other
  modified_base (358)..(358): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaaggtaaagtgtacattggtacaggcagaagccaggccaggccctgtggtgtcgtcgtatgatagcgaccggcctcgaggactcccgtgacgcgattcgtcgtcgcctaccaactcgtacgggaaccnccggccaccctcgaccactcgacgcgaggggtaccgaaacgggcccgggggatacgggacggcccgtaaactacgttacgtcgtacgagggttggtaggggtattagggtaggtggtagtacgtactacgtccaagttaccggtcttacggaaacgtcggggaacctaacggttctacccggtacctacggtacgaccgacccgaacgtccccaaaacccgctcgtaccactccgttccgtacccctcccc

SEQ ID NO: 433361 - DNA, 621 bp, Homo sapiens
  misc_feature: GZ8MTXP02HXR92.4.57.F02.1.454.CMB.2.raw
  modified_base (300)..(300): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcgccccagggcagacggcaggataacctgtgtgggaaccagcagtcggaaggtaaaagtgtacagttggtacaggcagaagccaggccaggcccctgtggtggtcgtccgttangatagccgaccggcctcgagggactcccgtgagcgtattccctcgtcgcctaccaactcgtacgggacctaccgggcccacccgtcgaaccctagtaccacggaccgacggggaccggaaacgggcccgggggagtcgggacgggacccgtaacttaacgttaaccgtggtacgagggttgggtagggagttagggtaggtgggtagagtacagtacctacgttaccgtcgtacggaacgttcgggaaccgtaacggtccctaccgtccgtaccgtcgaaccgaccccgaaggcccaaccgtccactcgtacctactcccg

SEQ ID NO: 433362 - DNA, 693 bp, Homo sapiens
  misc_feature: GZ8MTXP02G79NX.4.57.F02.1.454.CMB.2.raw
  modified_base (296)..(296): a, c, t, g, unknown or other
  modified_base (356)..(356): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtacagttggtacaggcagaagcaggccaggcccctggtggtggtcgtcgttangatagcgaccggcctgaggactccctgagcgattctctggcctccaactcgtgggaaccncgggcccacccgtgaccatcacgcaaggggtcgaaggcccgggggatgggacggcccgtaacttacgttaccgtggtaccaggggttgtaggggtagttagtagggtgggtagtagtacgtaacgtaccgtaacgttacgttccgtttacggggaaaccgttcggggaaccctaaaacggggttccccgttacccggttcccttaaccgggttacccgtaaccgggaccccccgtaaacggggacccccccaaaaaacccccggttccgtttaccgggtaaccccctaaaccgtttacccgtttaccccgggtttacccccccggtttccccccccg

SEQ ID NO: 433363 - DNA, 659 bp, Homo sapiens
  misc_feature: GZ8MTXP02ICWXU.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtggaggtcggggggaggcgtggtccagcctgggggtccctgagactctcctgtgcagcgtctggattcgccttcagtgcctatggcatgcacgtgggtccgccaggctccaggcaaggggctggaatgggtgcagttatagttggttgatggaaactaacaaattctatgcagactccgtgaaggcgatcacatctcagagacaattcgagaacactatgaaatctaacagactagaaacagtctagagacgccgaaggacacggtctgtactattattgtgacgagagtaaaggtgtactagttcggttccgttttgaccgtaagggtcgggggtaccgaacgggggtaaaccccgttgggtaccctacccggttccgttaccctcgaacgtccgtttaccccgaaccggtaaaccgggtccccgtaacgttcccggttcccctttccccccggtacggtccccgtccccgttcgacccttcccggaacgggaaccgtaccctaacccggtccggtccgggggtacccgaaccggtaccggccccgggg

SEQ ID NO: 433364 - DNA, 661 bp, Homo sapiens
  misc_feature: GZ8MTXP02JZ3PZ.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaagtgtacattggtacaggcagaagccaggccaggcccctgtggtggtcgtccgttatgatagcgaccggccctcgagggactcccgtgagcgattcctctggctccaactcgtgggacacggccaccctgaccatcagcaggggtcgaaggccgggggatgggacgggaccgtacgtaagttaaccgtggttacgaaggggttggtagggggattagggttagggtggggttagaacttcggaattcccgtaagttaccggtttccgttaccggggaaaccgtttacgggggaaaccctaaaggggttcccttaccccggtacccgtttaaccgtacccgaaccggacccccgtaaaacggggacccccgtaaaaccgttcccctaaacgttccggttacccgaaccgttttcccccg

SEQ ID NO: 433365 - DNA, 571 bp, Homo sapiens
  misc_feature: GZ8MTXP02IMSPQ.4.57.F02.1.454.CMB.2.raw
  modified_base (219)..(219): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacggcaggataactgtgtggaaccngcagtcggaaggtaaagtgtacagttggtacaggcagaacgccaggccacgccctgtggtgtcgtcgtatgatagcgaccggcctcgaggactcccgtgacgcgtattctcgtcggcctaccaaactcgtacggaacaccggcccacccgtgaccatcagcgagggtcgaacggccggggatcggacggccgtactacgtacctgtcgagggtgtagggataggtagtggtagatgactccgattacgtcgttacggaacgtcggaaccgtaacgggtcctccggtaccgttaccgacaccggacccgaacgaccccaacccgactcgtacacctcttccgtaccctacccc

SEQ ID NO: 433366 - DNA, 548 bp, Homo sapiens
  misc_feature: GZ8MTXP02J36YX.4.57.F02.1.454.CMB.2.raw
  modified_base (177)..(177): a, c, t, g, unknown or other
  modified_base (228)..(228): a, c, t, g, unknown or other
  modified_base (342)..(342): a, c, t, g, unknown or other
  modified_base (445)..(445): a, c, t, g, unknown or other
  modified_base (451)..(451): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctnagtgtcagtcggccccagggcagacggccaggataacctgtgtgggaaccngcagtcggaagtaaagtgtacattggacaggacagaacgccaggccaggcccctgtggtggtcgtccgttatgatagccgaccggccctgagggatccccgtgacgcgattccncgtggcctaccaacttcgaggggaccacggcccacctgaccatcagcgagggtcgaagccggggatgagggcccatattacgtgtcgaggtgtgggatagtgngggtanatcactctagtacgtacgtacggacgtcggaccgtacgtcctccgtacctaccgacgaccgacccgaacgacctacctcctactccgtctaccttcg

SEQ ID NO: 433367 - DNA, 524 bp, Homo sapiens
  misc_feature: GZ8MTXP02H9U8Y.4.57.F02.1.454.CMB.2.raw
  modified_base (351)..(351): a, c, t, g, unknown or other
  modified_base (407)..(407): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggcccagggcagacggccaggataacctgtgtgggaaccagcatcggaggtaaaagtgtacattggtacaggcagaagccaggccaggcccctgtggtggtcgtcgtatgatagcgaccggcctcagggatccctgagcgattctctggcctccaactctggggaacncgggccaccctgacccatcagcagggtcgaagccggggatgacggccgatattacngtcaggtgtgggataggtagtggtgagtcatccatacgtcttcggaacgtgggaaccaggtctccgtctacgtcacgccaaggcccaacccgctcgtcactccgtcgttccccgccc

SEQ ID NO: 433368 - DNA, 534 bp, Homo sapiens
  misc_feature: GZ8MTXP02JMI9U.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggccccctgtggtggtcgtccgttatgatagcgaccggccctcagggactccctgagcgattcctctggctccactcgtgggacacggccaccctgaccatcagcgagggtcgaaacgccggggatgacggccgactattacgtgtcgaggtgtagggatagtaggtgggtgagtcatccatacgtcgttcggaacgtcgggacaaggtcctccgtacgtacgtcacgccgaaggcccaaactccactcgtacacttcccg

SEQ ID NO: 433369 - DNA, 501 bp, Homo sapiens
  misc_feature: GZ8MTXP02FMZ0L.4.57.F02.1.454.CMB.2.raw
  modified_base (356)..(356): a, c, t, g, unknown or other
  modified_base (382)..(382): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctgggcggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcacatctccagagacaatttcgaagaacacattgaatctacagatgaacagtctgagngccgagacacgctgtctattatgtgngagagtaagtgtcatgtctttagacagtgggcaggacctgtcacgtctctcagctccacaacggccacgtcgtcttcccctgcgcctcgctccaagacgcactcgtcggggcacgacgg

SEQ ID NO: 433370 - DNA, 533 bp, Homo sapiens
  misc_feature: GZ8MTXP02ILKK1.4.57.F02.1.454.CMB.2.raw
  modified_base (405)..(405): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgtatgatagcgaccggccctcgagggatccctgagcgattctctggctccaactctagggaacacggccacctgacccatccagcagggtcgaagccgggatggagccgactatacngtcaggtgtaggggataggtagtggtgatcgaatccatacgtcttcggaactggggaccaaggtctccgtcctacgtcacgcccaaggcccaaaccccgatacgtccactcctacgtttcccccaccc

SEQ ID NO: 433371 - DNA, 555 bp, Homo sapiens
  misc_feature: GZ8MTXP02IJYZO.4.57.F02.1.454.CMB.2.raw
  modified_base (221)..(221): a, c, t, g, unknown or other
  modified_base (275)..(275): a, c, t, g, unknown or other
  modified_base (286)..(286): a, c, t, g, unknown or other
  modified_base (366)..(366): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccacctcagtgtcagtcggcccagggcagacggccaggataacctgtgtggaaccngcatcggaagtaaagtgtacattggtacaggcagaagccaggccaggcccctgnggtgcgtcgtntgatagcgaccggcctcaggagtcctcgagcgattctctcgcgtccaactctggaacgaccgccgacctcgaccactacngcgaggcgagcccgggagtgaggccggactattactagtcgaggtggtagggagtaaggtaggtggtaggatacagtccattacggttacttcgggtaaaccgtagggacccgtaaaggtaccgttccgtccgttacgacgacgacccgacggaccaaccccaactcgtccactcgttctccctacccc

SEQ ID NO: 433372 - DNA, 527 bp, Homo sapiens
  misc_feature: GZ8MTXP02JJQQL.4.57.F02.1.454.CMB.2.raw
  modified_base (292)..(292): a, c, t, g, unknown or other
  modified_base (351)..(351): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagagcaggccaggcccctgtggtggtcgtccgttangatagcgaccggccctcgagggatccctgagcgattctctggctccaactctgggaacncggccacctgaccatcagcagggtcgaagccggggatggaggccgactatactgtcaggtgtgggataggtagtggtgattcgatccatacgtcttacggaacgtgggacctaaggtctaccgtcctacgtcacgacccaaggcccaacccgactcgtcactctcgtccctacccc

SEQ ID NO: 433373 - DNA, 556 bp, Homo sapiens
  misc_feature: GZ8MTXP02GT83X.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtacattggtacaggcagaagccaggccaggcccctgtggtggtcgtccgttatgatagcgaccggcctcgagggactccctgacgcgtattccctcgtggcctaccaactcgtaggggaccaccgggcccaccctgacccatcagcgagggtcgaaggccgggggatggacggccgaacttattaccgtgtcgagggtgtagggatagtaggtgggtagatcatccaatcgtcgttacggaacttgggacctaaggtcctccgtctacgtcacgcccaaggcccaaacgtccacgtcgtaccacttccg

SEQ ID NO: 433374 - DNA, 568 bp, Homo sapiens
  misc_feature: GZ8MTXP02HL84B.4.57.F02.1.454.CMB.2.raw
  modified_base (352)..(352): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaggtaaagtgtacattggtacaggcagaagccaggccaggcccctgtggtgtcgtccgttatgatagcgaccggccctcagggatccctgagcgattctctcggcctccaactctgggaacncgggccaccctgacccatcagcagggtcgaaagcccggggatggaggcccgaatattaactgtcagggtgtaggggattaggtaggttggtaggattcagtcccgtaatacgttcttacgggaaacgtcgggaccaaggtcctccgtacctacggtccacggcccaaacggcccaaaccccgactcgtacctaactcctacgtttacccccacccc

SEQ ID NO: 433375 - DNA, 560 bp, Homo sapiens
  misc_feature: GZ8MTXP02JK5A5.4.57.F02.1.454.CMB.2.raw
  modified_base (368)..(368): a, c, t, g, unknown or other
  modified_base (428)..(428): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcgagggactcccgtgacgcgtattccctctggcctaccaactcgtagggaccncgggcccaccgtgaccatcagcacgggtcgaaggccggggatggacgccgactagttacngtcagggtgtgggataggtagtgggtgatcatcagtacgttcgttacgaacgttcggggacctaagggttcctccggttaccgtacgtccacgaccccgaaggcccaaaccgtccacgtcgtccacttcccg

SEQ ID NO: 433376 - DNA, 700 bp, Homo sapiens
  misc_feature: GZ8MTXP02IXPSK.4.57.F02.1.454.CMB.2.raw
  modified_base (298)..(298): a, c, t, g, unknown or other
  modified_base (365)..(365): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtacattggtacaggcagagcaggccacggcccctgtggtggtcgtcgttancgatacgccgaccggcctcgagggatcccgtgagcgattcctcgtggctccaactccgtagggaccnccgggtcccaccctgaacccatcgacgacgacggggtaccggaaacgggcccgggggaatacggggacggacccggtaactaacgtttaaccgtgtacgtaggggttaggttagggggaagttaggtaagggtgggttaggaaacttccggaaacgtccctaaagttaccggttaccgttaaccggggtaaacgttaccgggggaaaccgtaaacgggttcccgtacccggttaccccgtttaaaccggtaccgaacccggtaaccccgtaaccggggtaaccccaaaaccgtttccccgaaccgtttccgacccgtttaaccctttacccccgg

SEQ ID NO: 433377 - DNA, 549 bp, Homo sapiens
  misc_feature: GZ8MTXP02GBLZD.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcgagggatccctgagcgattctctggctccaactctgggaacacggccaccctgaccatcagcagggtcgaaggcccggggatggaggccgactatactgtcaggtgtagggataggtagtggtgagtcagtccatacgtcgttacggaacgtcgggaacctaaggtccgtccgtccgtacgtacacgcccaacggcccaaaccccgtctacggtaccacctcctcgttcccctaacccc

SEQ ID NO: 433378 - DNA, 540 bp, Homo sapiens
  misc_feature: GZ8MTXP02F4RUY.4.57.F02.1.454.CMB.2.raw
  modified_base (481)..(481): a, c, t, g, unknown or other
  modified_base (513)..(513): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaagtgtacattggtacaggcagagccaggccaggcccctgtggtggtcgtccgttatgatagcgaccggccctcgagggactccctgagcgattctctcggctccaactcgtagggaaccacgggcccaccctgaccatcagcaggggtccgaaggcccggggatcggaggccgactattactgtcagggtgtagggataggtagtggtgagtcatccatacgtcttcggactgggacaggtcnccgtcctacgtcacgcccaacggcccaacccnctcgtaccactctccgttcccctaccc

SEQ ID NO: 433379 - DNA, 559 bp, Homo sapiens
  misc_feature: GZ8MTXP02HYKS3.4.57.F02.1.454.CMB.2.raw
  modified_base (401)..(401): a, c, t, g, unknown or other
  modified_base (428)..(428): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaggtaaaagtgtacatggtacaggcagaagccaggccaggcccctgtggtggtcgtcgttatgatagcgaccggccctcgagggactccctgacgcgattcctctcggctccaactcgtagggacaccggccaccctgaccatcagcagggcgaaagccggggaanggacggccgactatactgtcgaggtgngggatagtaggtggtgatcgatccgagtacgtcgttacgggaaacttcgggaacctaagggtcctacccggtccttaaccgtcgaacgacccgaaggacccaaacttcccacgttacgtcctaacttcccg

SEQ ID NO: 433380 - DNA, 492 bp, Homo sapiens
  misc_feature: GZ8MTXP02JDK85.4.57.F02.1.454.CMB.2.raw
  modified_base (433)..(433): a, c, t, g, unknown or other
  modified_base (455)..(455): a, c, t, g, unknown or other
  modified_base (458)..(458): a, c, t, g, unknown or other
  modified_base (469)..(469): a, c, t, g, unknown or other
  modified_base (474)..(474): a, c, t, g, unknown or other
  modified_base (485)..(485): a, c, t, g, unknown or other
tcagagcactgtagcacgaccggtgctcgatttagctcgatatagttgggtttgggggaagaggaagactgacggtcctcccaggagttcaggtgctgggcaccgtgggcatggggaggcgtggtccagcctgggggtccctgagactctcctgtgcagcgtctggattcgccttcagtgcctatggcatgcactgggtccgccaggctccaggcaaggggctggaatgggtgcagttatatggtttgatggaactaacaaattctatgcagactcgtgaaggccgattcaccatctccagagacaatttcgagaacacattgaatctacagatgaacagtctagagagccgagggacacggctgtctattattgtgcgagagtaagtggtcatggtctttgaccagtgggcaggacctggtcacgtctctcngctcacaggccatcgtctcccngcncctcgctcagncgacncgtcgggcacncgcgccg

SEQ ID NO: 433381 - DNA, 557 bp, Homo sapiens
  misc_feature: GZ8MTXP02JHGOV.4.57.F02.1.454.CMB.2.raw
tcagagcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaactaacaaattctatgcagactccgtgaaggccgattcaccatctccagagacaatttcgagaacacattgaatctacagatacgaacagtactgagagccgaggacacggctgtctattatgtgcgagagtagtgtcatcgtctttgactaggtcggggaccagggaacctggtccaccgtcctcctcacgtccttaccacgaacgggccctagtccggttcccttcccccgtggcccggtccctcggccctaccgacggacgcctaccgtcggtacgggggccaacgcggccggtcccgg

SEQ ID NO: 433382 - DNA, 565 bp, Homo sapiens
  misc_feature: GZ8MTXP02JUOMY.4.57.F02.1.454.CMB.2.raw
  modified_base (355)..(355): a, c, t, g, unknown or other
  modified_base (365)..(365): a, c, t, g, unknown or other
  modified_base (392)..(392): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatggggtggcagttatatggtttgatggaactaacaaattctatgcagactccgtgaaggccgattcaccatctccagagacaatttcgagaacacatgtaatactacagatagacagctgagagcgngacgactcgngtctatattgtgtgagagtagtggtcntagttcgtttacgtacgagtgggccggacggaaccggtcggccgtaccgtaccgttccgtcacgtaccgtaccctaaccgaacggacccgaccgtccgtcccgttcccccgtcgccgtccctcgcgtccgaccggacgccgccgttcgcggggacgaccgacggccggcccgg

SEQ ID NO: 433383 - DNA, 545 bp, Homo sapiens
  misc_feature: GZ8MTXP02GZMTQ.4.57.F02.1.454.CMB.2.raw
  modified_base (299)..(299): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtacattggtacaggcagaagccaggccaggcccctgtggtggtcgtcgttangatagcgaccggccctcgagggactcccgtgagcgtattcctcgtggctccaactcgtagggaccaccggccaccctgacccatcagcgagggtacgaacggccggggatggacggccgatatacgtgtcgaggtgtgggattaggtagtgggtagatcatcatacgtctacggaacgtcgggacctaaggtcctaccgtccgtacgtcacgacccgaaggccaacgtccacgtcgtaccacttcc

SEQ ID NO: 433384 - DNA, 696 bp, Homo sapiens
  misc_feature: GZ8MTXP02IC0L6.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcaccgtggtgggaggtcgggggaggcgtggtccaggccgtgggggtccctgagactctcctgtgcagcgtctggattcgcttcagtgcctatggcagtgccacgtcggggtcccgccaggcctcccgagggccgaaggggctagggaagtggggtgactagttattagtggggtttagagtacgggaaacttaaaacgtaaatttctagttgacgtaacgtacccgttccgggtaggaaaccggggccctaattcccgaaccctacgttcccacccaaaggtaactaaacttaaacgtttaccggaaacgaaacctaaacctaaagtttacgaaaacttcctaaacagtaaacgttacgaaacgtaggttcgtaaggaacggacggaacccgggaacggaaccgtacggggtccttaggttaccttaagtttacgtggttacggacggtaaggtagttaaggttcggtaacgttcggttacggtttccgtttaacggg

SEQ ID NO: 433385 - DNA, 526 bp, Homo sapiens
  misc_feature: GZ8MTXP02JSKK0.4.57.F02.1.454.CMB.2.raw
  modified_base (501)..(501): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagcaggccaggcccctgtggtggtcgtcgttatgatagcgaccggcctcgagggatccctgagcgattctctcggctccaactctgggaacacgggccaccctgaccatcagcagggtcgaagccggggatggaggccgactattactgtcaggtgtgggataggtagtgtgagtcatccatacgtcttcggaactgggacctaaggtctccgtctacggtcacgcccaaggcccaaacccnctcgacacctctcgttcccgtcccc

SEQ ID NO: 433386 - DNA, 563 bp, Homo sapiens
  misc_feature: GZ8MTXP02J1E13.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtacattggtacaggcagaagccaggccaggcccctgtggtggtcgtccgttatgatagcgaccggcctcgagggactccctgagcgattctctggcctccaactcgtagggaaccacgggccaccctgaccatcagcgagggtcgaacggccggggatcggacggcccgactattactggtctaggtggtagggataggtaggtggtagagtcactcctaatacgttcttacgggaactcggggactaacggtctaccgtcgtaccgtcacgacccgaacggcccaacccgtctacgtccactcctacgtcccctacccc

SEQ ID NO: 433387 - DNA, 552 bp, Homo sapiens
  misc_feature: GZ8MTXP02IZZG2.4.57.F02.1.454.CMB.2.raw
  modified_base (358)..(358): a, c, t, g, unknown or other
  modified_base (397)..(397): a, c, t, g, unknown or other
  modified_base (417)..(417): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaggtaaaagtgtacattggtacaggcagaagccaggccaggccccctgtggtggtcgtccgtatgatagcgaccggccctcagggatccctgagcgattccgctggctccaactcgtgggacncggccacctgaccatcagcagggtcgaaggcccgggganggacggccgacgtattacgngtcagggtgtagggatagtagtgggtgatcatccagttacgtcgttacggaacgttcgggaccaagggtcctccggtacctacgtccgacgaccccaacgggacccaaactcccaaccgtcgtaccactttcccg

SEQ ID NO: 433388 - DNA, 552 bp, Homo sapiens
  misc_feature: GZ8MTXP02GOC8B.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcgagggactcccctgagcgattcctcgtggcctccaactcgtagggaccacgggcccacccgtgacccatcgagcgagggtacgaaggccggggatggacggccgactattacgtgtcgaggtgtgggataggtagtgggtgatcatccaagttacgtcgttacggaacgttcgggaccgaaggtcctaccgtcctacgtccacgcccaaggcccaaacgtccactcgtaccactccg

SEQ ID NO: 433389 - DNA, 550 bp, Homo sapiens
  misc_feature: GZ8MTXP02FY4RC.4.57.F02.1.454.CMB.2.raw
  modified_base (212)..(212): a, c, t, g, unknown or other
  modified_base (219)..(219): a, c, t, g, unknown or other
  modified_base (292)..(292): a, c, t, g, unknown or other
  modified_base (417)..(417): a, c, t, g, unknown or other
  modified_base (445)..(445): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtcggcccagggcagacggcaggatacctgtgnggaaccngcagtcggaaggtaaagtgtaacagttggtacaggcagaagccaggccacggccctgtggtggtcgtcgttangatacgcgacccggcctcgaggactccctgacgcgtattctcgtcggcctaccaactcgtacggaaccacggcccacctgaccatcagcgagggtcgaaggccgggatgacgccgatagttacgngtcgaggtgtagggataggtaggtggtnatcactcgtatacgtcgtacggaacgtggggaacctacggtcctccgtactacgtcaccgacccgaggaccccaaaccgctcgacactcctaccgtcccctaccc

SEQ ID NO: 433390 - DNA, 550 bp, Homo sapiens
  misc_feature: GZ8MTXP02GTBQ0.4.57.F02.1.454.CMB.2.raw
  modified_base (226)..(226): a, c, t, g, unknown or other
  modified_base (298)..(298): a, c, t, g, unknown or other
  modified_base (362)..(362): a, c, t, g, unknown or other
  modified_base (419)..(419): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggcaggataacctgtgtgggaaccngcatcggaaggtaaaagtgtacattggtacaggcagaagccaggccaggcccctgtggtggtcgtccgttangatagcgaccggccctgagggatccctgagcgtattcctctggctaccaactcgtaggggaccncgggcccacccgtgacccatcagcgaggtacgaagccggggatgaggccgatatacngcgaggtgtgggataggtagtgggtagatcagtccaagtaccgtcgttacggaacttcgggaaccctaaggttcctacccgttactaccgtcacgacccaaggcccaaacgtccacgtcgtaccacttccg

SEQ ID NO: 433391 - DNA, 570 bp, Homo sapiens
  misc_feature: GZ8MTXP02IP32S.4.57.F02.1.454.CMB.2.raw
  modified_base (226)..(226): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccngcatcggaaggtaaagtgtacattggtacaggcagaagccaggccaggcccctgtggtggtcgtccgttatgatagcgaccggccctcgagggactcccgtgacgcgtattcctcgtggcctaccaacgtcgtacgggaccacgggcccacccgtcgacccatcgagcgaggggtcgaaggccgggggatggaggccgacttagttacgtgtcgagggtggtagggagttaggtagttgggtagatcgatcagttacgttacgttacggaacgtcgggacctaaggtccttacccgtctaccgtacgacgacccgaacggaccaactccgactcgtcacttccg

SEQ ID NO: 433392 - DNA, 525 bp, Homo sapiens
  misc_feature: GZ8MTXP02IKNR4.4.57.F02.1.454.CMB.2.raw
  modified_base (415)..(415): a, c, t, g, unknown or other
  modified_base (436)..(436): a, c, t, g, unknown or other
  modified_base (439)..(439): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctgggggtccctgagactctcctgtgcagcgtctggattcgccttcagtgcctatggcatgcacgtgggtccgccaggctccaggcaaggggctggaatgggtgcagttatatggttgatggaaactaacaattcatgcagactccgtgaaggccgattcaccatctccagagacaatttcgagaacactattgaaatctaacagatgaacagtctagagacgccgagacacgggtctgtactattatgtgacgagagtagtgtacagtgtctttgacngtggcaggacctgtcacgtcnctnagcttaccgacgaacggccagtccgtcttccccgcggccgccctcgacctcgacggaacgccacgtcgtcggggccacgcggccgg

SEQ ID NO: 433393 - DNA, 528 bp, Homo sapiens
  misc_feature: GZ8MTXP02JPHOS.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtcgtatgatagcgaccggcctcgagggactcccgtgagcgattctctcggctccaactcgtgggaacacggccaccctgaccatcagcagggtcgaagccgggggatggaggccgactatactgtcaggtgtggggataggtagtgggtgatcatccatacgtcgtcggaactgggacccaaggtctccgtcctacggtcacgcccaacggcccaacccgactcgtcactctcgtcccgccc

SEQ ID NO: 433394 - DNA, 540 bp, Homo sapiens
  misc_feature: GZ8MTXP02IDKQZ.4.57.F02.1.454.CMB.2.raw
  modified_base (361)..(361): a, c, t, g, unknown or other
  modified_base (417)..(417): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgacccggcctcgagggactcccctgagcgattcctctggctccaactctgggacncgccaccctgaccatcagcgaggggtcgaaggccggggatggaggccgatattacngtcaggtgtgggatagtaggtgggtagagtcatcccatacgtcgttacggactcggggacctaaggtcctaccgtctacgtcacgacccaaggaccccaaacgtccactcgtaccacttcccg

SEQ ID NO: 433395 - DNA, 512 bp, Homo sapiens
  misc_feature: GZ8MTXP02JO7VC.4.57.F02.1.454.CMB.2.raw
  modified_base (357)..(357): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaagtgtacattggtacaggcagaagccaggccaggcccctgtggtggtcgtccgttatgatagcgaccggcctcagggatcccctgagcgattccctctggctccaactctgggacncggccacctgaccatcagcagggtcgaagccggggatggagccgactattactgtcaggtgtgggatagtagtggtgatcatcatacgtcttcggaactgggaccaaggtctaccgtcctacgtcacgccaaggccaactccactcgtcactccg

SEQ ID NO: 433396 - DNA, 544 bp, Homo sapiens
  misc_feature: GZ8MTXP02I1MJE.4.57.F02.1.454.CMB.2.raw
  modified_base (337)..(337): a, c, t, g, unknown or other
  modified_base (357)..(357): a, c, t, g, unknown or other
  modified_base (411)..(411): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggcctcgagggactccctgacgcgattccnctggctccaactctgggacncggccaccctgaccatcagcgagggtcgaagccggggatgaggccgatattacngtcgaggtggtgggattagtagtgggtagatcatccgattccgtacgttcggaacgtcggggacctaagggtcctccgtaccgtacgtccacggaccccaaggccccaaacgtcccaactcgtacacttcccg

SEQ ID NO: 433397 - DNA, 523 bp, Homo sapiens
  misc_feature: GZ8MTXP02IVJPO.4.57.F02.1.454.CMB.2.raw
  modified_base (350)..(350): a, c, t, g, unknown or other
  modified_base (499)..(499): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggccaggataacctgtgtgggaaccagcatcggaggtaaagtgtacattggtacaggcagaagccaggccaggcccctgtggtggtcgtccgttatgatgcgaccggcctcgagggatccctgacgcgattctctggcctccaactctggaacncggccacctgaccatcagcagggtcgaagccggggatggacggccgactattactgtcaggtgtgggatagtagtgtagatcatcatacgtcgttcggaactgggacctaacggtctaccgtctacgtcacgcccaacggccaaacccncgtcgtcactcctcgttcccaccc

SEQ ID NO: 433398 - DNA, 650 bp, Homo sapiens
  misc_feature: GZ8MTXP02F4I7P.4.57.F02.1.454.CMB.2.raw
  modified_base (366)..(366): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgtacaggctctgtgacctcatatgtgctgactcagcccaccctcagtgtcagtcggccccagggcagacggccaggataacctgtgtgggaaccagcatcggaaggtaaaagtgtacattggtacaggcagaagcaggccaggcccctgtggtggtcgtcgttatgatagcgaccggccctcgagggactccctgagcgattctcctggcctaccaacttcgtagggaaccnccgggcccacccgtcgaccctatccagccgaagggggtcgaaacgggcccgggggaatcgggaacgggcccgtaacgttagttaaccgtggtacgaaggggttggtaggggattagggttaggtgggtaggaactccagttcccgtaagttaccggttccgttacgggtaaaccgtcggggaaaccctaaggggttccctacccggttcccgtaaccggtccgaaccggaccccgaaacgggaaccccaacctacccaccgttcgtaccaccttcgtttccccg

SEQ ID NO: 433399 - DNA, 527 bp, Homo sapiens
  misc_feature: GZ8MTXP02JUY0A.4.57.F02.1.454.CMB.2.raw
  modified_base (361)..(361): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaagtgtacattggtacaggcagaagccaggccaggcccctgtggtggtcgtccgttatgatagcgaccggccctcgagggatcccgtgagcgattcctctggctccaactctgggaccncgggccaccctgaccatcagcgagggtcgaaggccggggatggaggccgactattactgtcaggtgtaggggataggtagtgggtagatcatcatacgtcttcggaatcgggaccaggtctccgtctacgctacgacccaaggcccaactccactcgtcacttccg

SEQ ID NO: 433400 - DNA, 547 bp, Homo sapiens
  misc_feature: GZ8MTXP02I9JJ6.4.57.F02.1.454.CMB.2.raw
  modified_base (375)..(375): a, c, t, g, unknown or other
  modified_base (490)..(490): a, c, t, g, unknown or other
  modified_base (511)..(511): a, c, t, g, unknown or other
tcagagcactgtagcacgaccggtgctcgatttagctcgatatagttgggtttgggggaagaggaagactgacggtcctcccaggagttcaggtgctgggcaccgtgggtatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaactaacaaattctatgcagactcgtgaaggccatcaccatctcagagacaattcgagaacacattgaatctacagatgaaccagtctagagagccgaggacacggctgtactattattgngacgagaagtaagtggtcagttggttcctttgaccgaggtggggaccaaggggaccctggccacgtctcctcacgcctaccacgaacggcccaagtccggtcctccccgtggccncccgtcgaccgtccaacggcnccaaccgtcgacggggcacgacggccggccgtcggg

SEQ ID NO: 433401 - DNA, 616 bp, Homo sapiens
  misc_feature: GZ8MTXP02I0U25.4.57.F02.1.454.CMB.2.raw
  modified_base (275)..(275): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtgggaaccagcatcggaggtaaagtgtacattggtacaggcagaagccaggccaggccctgnggtgtctcgtatgatagcgaccggcctcgtaggactcctgagcgactctctcggtctccaacctcgtggaaccgaccggcccgaccctacggacccactaccagacgacgggtacggaaacggacccggggacgtggacggccggacgttaacttaacgtcgtacgagggtggtggggaattaaggtaggttcgggttagagttacacgtaccagttaccggttacgttacggaacgtcgggaaccgtaaacggttccgtcccggtacctacggtaccacgaaccccgaacggacccaaccccgtactacggtccaaccgtcctccgtttaccctaccccc

SEQ ID NO: 433402 - DNA, 690 bp, Homo sapiens
  misc_feature: GZ8MTXP02HI1SB.4.57.F02.1.454.CMB.2.raw
  modified_base (564)..(564): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcaggtcggccccgagggcaggacggccaggataacctggtagtagggaaccagcagtacgggaaggtaaaagtgtaactagttggtaacgaggacaaggaaacgccgaacggccgaccggtcccccgtgggtcgggttcggtccggttaccggttagtggacgtacggcccggacccggtccctacggacgggtacctcccgtagacgtcgtacttcccgtcgtcggcctaccgaacgtcggtaacggggaccaccgggacccaccgtacgacctacgcgaacgcggacggggtacggaaacgggccgggggaatacgggacggtaccgtacgttaacgttacgtcggtagaggggttggtagggattagggtaggtgggtanacgtcacgtccgtacgttacgtacgttaccggaagtaccggaccgtaacggttccgtaccgtaccgtacgtccgaaccgacccgaacgaccctaaaccgtccacgttccgtacctaccgttccccg

SEQ ID NO: 433403 - DNA, 628 bp, Homo sapiens
  misc_feature: GZ8MTXP02IF9AN.4.57.F02.1.454.CMB.2.raw
  modified_base (227)..(227): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccngcagtcggaaggtaaaagtgtaacattggtacaggcagaagccaggccaggcccctgtggtggtcgtccgttatgataggcgaccggccctcgagggactcccgtgacgcgtattcctcgtggcctccgaaacttcgtacggggaccaccgggcccaacccccgtgaacccagtcgacgacgaggggtacgaaagggcccgggggaatgggacggccgtaacttagtaacgtgtacgagggttggtagggagttaggtagggttgggtagtatacgtatccgtaagttaccgttccgttacgggaaacgttacggggaacctaacgggttccttacccggtaccgttaccgtcgaccgacccgaacggaccctaacgtcccgaactcgtacctacttcccg

SEQ ID NO: 433404 - DNA, 591 bp, Homo sapiens
  misc_feature: GZ8MTXP02GLUTH.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtaacattggtacaggcagaagccaggccacggcccctggtggtggtcgtccgtatgatagcgaccggccctcgagggactcccgtgacgcgtattcctcgtcggcctaccaactcgtacgggaaccaccgggcccacccgtcgacccatccgagcgacgggtacgaaacgggccggggaatcggacggcccgtactacgttactgtacgagggtggtagggataggtaggtggtgatcgactcagttacgtcgtacgggaacgtgggacctaacggtcctccgtacctacgtcacgacccgaacggaccccaacccgtacgtcgtaccacttctccgtcccctacccc

SEQ ID NO: 433405 - DNA, 519 bp, Homo sapiens
  misc_feature: GZ8MTXP02IUIH6.4.57.F02.1.454.CMB.2.raw
  modified_base (358)..(358): a, c, t, g, unknown or other
  modified_base (414)..(414): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtcgttatgatgcgaccggccctcgagggatccccgtgagcgattcctctggctccaactctgggacncggccaccctgaccatcagcgagggtcgaagccggggatggaggcccgaatatacngtcagggtgtgggataggtagtggtgatcgatcatcgtctcggaatcgggacaggtctccgtctacgtcacgacccaaggccctaacgtccactcgtcacttccg

SEQ ID NO: 433406 - DNA, 538 bp, Homo sapiens
  misc_feature: GZ8MTXP02IO15D.4.57.F02.1.454.CMB.2.raw
  modified_base (360)..(360): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggaggtcgggggaggcgtggtccagccgtgggggtccctgagactctcctgtgcagcgtctggattcgccttcagtgcctatggcatgcacgtggggtccgccaggcctccgaggcgaaggggctgggaatggggtggcagttatagtggtttnagtaggaactaacaaattctatgacagacctcgtagaacgggccgatcaccatctcagagactaattacgagaacaactattagaaatctaacagaatagaacagtctagagacgctaggacacggctgtactattagtgtgacgaagagtaagtgtactagttcggttactttacgg

SEQ ID NO: 433407 - DNA, 557 bp, Homo sapiens
  misc_feature: GZ8MTXP02JPWPZ.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaagtgtacattggtacaggcagaagccaggccaggcccctgtggtggtcgtccgttatgatagcgaccggccctcgagggactcccgtgagcgattcctcgtggctccaactcgtgggaccacggccacctgaccatcacgcgaggggtacgaacggccgggggatgggacggcccgatattacgtgtacgagggtgtgggataggtagtgggtagatcgatccgagtacgttcgttacggaacgtcgggaacctagggtcctccgtcctacgtcgacgacccgaacggccaacctccgactcgtaccacttccg

SEQ ID NO: 433408 - DNA, 543 bp, Homo sapiens
  misc_feature: GZ8MTXP02I5WIO.4.57.F02.1.454.CMB.2.raw
  modified_base (227)..(227): a, c, t, g, unknown or other
  modified_base (298)..(298): a, c, t, g, unknown or other
  modified_base (419)..(419): a, c, t, g, unknown or other
  modified_base (448)..(448): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcagtcggaaggtaaagtgtacattggtacaggcagagccaggccaggcccctgtggtggtcgtccgttangatagccgaccggccctcgagggactccctgagcgattcctctggctccaactcgtgggacaccgggcccacctcgaccatcagcgagggtcgaaggccggggatgacggccgatattacngtcaggtggtagggattagtagtgggtanagtcaagtccaatcgtctacggaacgtcgggacaaaggtcctaccgtacctacgtcacgacccaaggcccaacgtccacgtcgtccactttcccg

SEQ ID NO: 433409 - DNA, 632 bp, Homo sapiens
  misc_feature: GZ8MTXP02G2ZHG.4.57.F02.1.454.CMB.2.raw
  modified_base (215)..(215): a, c, t, g, unknown or other
  modified_base (219)..(219): a, c, t, g, unknown or other
  modified_base (225)..(225): a, c, t, g, unknown or other
  modified_base (293)..(293): a, c, t, g, unknown or other
  modified_base (363)..(363): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacngtgnggaacngcatcggaagtaaagtgtacattggacaggcagaagcaggccaggcccctgtggtggtcgtccgttangatagcgaccggcctagacgggatccctgacgcgtattcccgtcgtggcctaccaactcgtacgggaccnccgggccacccgtgaccatcacgcgtaggggtacgaaacggccgggggatagggacggtacccgaacgtttaacgttaaccgtggtaccgtaaaggggttggttaagggggtaattaggggtaggttacggggtagtacttacgacggtacctaagttaccggttcgttacggaaacgttcgggaaccgtaaggttcctaccggttacctacggtaccgacgaccccgaaggaccctaactacccgactcggtaacctaccgtttcccg

SEQ ID NO: 433410 - DNA, 534 bp, Homo sapiens
  misc_feature: GZ8MTXP02JF2OQ.4.57.F02.1.454.CMB.2.raw
  modified_base (293)..(293): a, c, t, g, unknown or other
  modified_base (310)..(310): a, c, t, g, unknown or other
  modified_base (331)..(331): a, c, t, g, unknown or other
  modified_base (352)..(352): a, c, t, g, unknown or other
  modified_base (434)..(434): a, c, t, g, unknown or other
  modified_base (450)..(450): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagagccaggccaggcccctgtggtggtcgtccgttangatagcgaccggccctnagggatcccgtgagcgattcnctggctccaactctgggaacncggccacctgaccatcagcagggtcgaaggccggggatggaggcccgactagttactgtcaggtgtgggataggtagtggtnagtcagtccatacgtntcggaatgggaccaggtctccgtcctacgtcacgacccgaacggacccaacccgacgtcgtaccactctccgtttccccgcccc

SEQ ID NO: 433411 - DNA, 548 bp, Homo sapiens
  misc_feature: GZ8MTXP02GFSFS.4.57.F02.1.454.CMB.2.raw
  modified_base (277)..(277): a, c, t, g, unknown or other
  modified_base (290)..(290): a, c, t, g, unknown or other
  modified_base (405)..(405): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggcaggataacctgtgtgggaaccagcatcggaaggtaaaagtgtacattggtacaggcagaagccaggccaggcccctgnggtgtcgtcgtangatagcgaccggcctcgagggactccctgagcgattctctcggctccaactctgggaacacgggcccaccctgaccatcagcagggtcgaaagccggggatgagccgatattacngtcaggtgtagggatagtagtgtgatcactccatacgtcttaggaactgggacctaaggtcctccggtacctaacggtcaacggaccccaacggaccccaaaaccccgacgtacgtaccacctcctccgttacccccaccccg

SEQ ID NO: 433412 - DNA, 510 bp, Homo sapiens
  misc_feature: GZ8MTXP02HT12C.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtggtccagcctgggggtccctgagactctcctgtgcagcgtctggattcgccttcagtgcctatggcatgcactgggtccgccaggctccaggcaaggggctggaatgggtgcagttatatggttgatggaactaacaaattctatgcagactccgtagaagggccgattcacatctccagagacaattcgagaacacattgaaattctacagatagaaacagtctgagagccgaggacacggctgtcttattatgtgcgaagagtaagtggctagtcgttcctttg

SEQ ID NO: 433413 - DNA, 742 bp, Homo sapiens
  misc_feature: GZ8MTXP02F2NJ1.4.57.F02.1.454.CMB.2.raw
tcagagcactgtagcacgaccggtgctcgatttagctcgatatagttgggtttgggggcctaaggaagaagcactggtggtgcctcagccatggcctggaccgttctcctcctcggcctcctctctcactgcacaggctctgtgacctcatatgtgctgactcagccaccctcagtgtcagtggccccagggcagacgccaggataacctgtgtgggaaccagcatcggaaggtaaagtgtacagttggtacaggcagaagccaggccaggcccctggtggtggtcgtcgttatgatacgcgaccggccctcgagggactcccgtgacgcgtattccgtctcggccctccaactcgtacggggaaaccaccggtcccacccgtgaacccataccgagcgaagggggtacgaaacgggcccgggggaatcgggaacggtacccggaaacttaacgttaccgtaggttacggaaggggttggtagggggtaaagttaagggttaggttaggggttaggacttaccgaacgttaccccgtaaggttaccggttaccgtttaaccggggaaaccgttacgggggaaacccttaaaacgggggttcccttaccccgggtttacccgttaaccggttaccgaacccggtaaccccgaaaacccggggacccccaaaaccccccgtaacgttccggtaacctacccgtttacccgttcccggtttacccccctaacccccgtttccccg

SEQ ID NO: 433414 - DNA, 576 bp, Homo sapiens
  misc_feature: GZ8MTXP02I8L65.4.57.F02.1.454.CMB.2.raw
  modified_base (225)..(225): a, c, t, g, unknown or other
  modified_base (281)..(281): a, c, t, g, unknown or other
  modified_base (295)..(295): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccngcagtcggaaggtaaagtgtacattggtacaggcagaagccaggccaggcccctgnggtgctccgtatgntagcgaccggccctcgagggacgtccctgagcgacttctctcggctccaactcgtgggaacgaccggccaccctcgaccactcacgcgagggtacgaaacggccggggagtggacggccgactacttacgtgtacgtaggtggtagggagtaggtaggttggtggtagtacactcctagtacgtacgttcggtaacgtcgggaaccgtaacggtcgtccgtccgtacgtcgacgacccgaacggacccaacccacgtcgtacactccgtcttccctacccc

SEQ ID NO: 433415 - DNA, 739 bp, Homo sapiens
  misc_feature: GZ8MTXP02GDJL9.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcatcggaaggtaaagtgtacattggtacaggcagaagccaggccaggccctgtggtggtcgtcgtatgatagcgaccggcctcgagggactcccgtgagcgtattcgtcgtcggcctaccaacttccgtacggggaaaccaccgggcccctaaccccgtaggaccctagtccgaacgggaccgaagggggtaccggaaacggggcccgggggaatacggggaacgggacccgtaacgttaacgtttaaccgtgggttaccgtaaggggttgggttagggggtaattaagggttagggttaggggtaggtacttacgaacgttacccgtaaggtttaccggttaccgtttaccggggaaaccgttacgggggaaaccccgtaaaacggggtttcccgttacccggttacccgttaaccggttaccgaaccggtacccccgaaacgggtacccccaaaacccccgtaccgttacggtaccctacctttcccgttaccggttccccccgtacccccg

SEQ ID NO: 433416 - DNA, 611 bp, Homo sapiens
  misc_feature: GZ8MTXP02I1UG2.4.57.F02.1.454.CMB.2.raw
  modified_base (224)..(224): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcagtcggaaggtaaaagtgtacattggtacaggcagaagccaggccaggcccctggtggtggtcgtccgttatgatagcgacccggccctcgagggactcccgtgagcgtattctcgtcggcctaccaactcgtagggaaccaccgggccaccctcgaccatcgagcgacggggtacgaacgggccggggagtggacggccgaacgttattacgtgcgagggtgtagggtagttaggtaggttaggtgagtacacgtccgaattaccggttctacgggaacgtacggggaacctaacgggtccttcccggtactaccgtacgaccgacccgaacggaccccaaaccccgtcgtacgtccacgttccgttccgttacccccgtcccc

SEQ ID NO: 433417 - DNA, 554 bp, Homo sapiens
  misc_feature: GZ8MTXP02HPEKW.4.57.F02.1.454.CMB.2.raw
  modified_base (382)..(382): a, c, t, g, unknown or other
tcagagcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaactaacaaattctatgcagactccgtgaaggccgattcaccatctccagagacaatttcgaagaacactattgaaatctacagatgaacagtctgagacgcgaggacacggctgtactattatgtgngagagtaagtgtctagtggttctttgactaggtcggggaccgacgggacctggtcaccgtctcctcacgcttccgacgaacgggccctagtccggtcccttccccgtcggccgtccccgtcgccgtccgaggacgccgaccgtcggtcggggaccaccgcggccggtcccgg

SEQ ID NO: 433418 - DNA, 556 bp, Homo sapiens
  misc_feature: GZ8MTXP02GQCN8.4.57.F02.1.454.CMB.2.raw
  modified_base (360)..(360): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaagtgtacattggacaggcagaagccaggccaggccctggtggtggtcgtcgttatgatagcgaccggcctcgagggactcccgtgagcgtattctctcggcctccaactcgtaggggaaccncgggcccaccctgaccatcgagcaggggtcgaacggccggggatggacggccgatactacgtgtcaggtgtagggataggtaggtggtgatcactccagtaccgtcgttcggaacgtacgggaccgtaaggtcctccgtccgtacgtccacgccccaaggcccaacccgctacgtaccactcttccgtccctcccc

SEQ ID NO: 433419 - DNA, 616 bp, Homo sapiens
  misc_feature: GZ8MTXP02ICJZJ.4.57.F02.1.454.CMB.2.raw
  modified_base (492)..(492): a, c, t, g, unknown or other
tcagagcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccattcaccatctccagagactaatttcgagaacacattagaatctaacagatagaacagtctgagagcgaggacacgctgtctattatgtgcgagagtaagtggtctagtcggttcttttagaccgtgggtcggggaccgaacggggtaaccccttgggtccacccgtcctccctacacgtcccttacccgaacccgaaacgggcccctaacgttcccggttccccttccccccgtggcccgtcccctcgccctccgaggacnccgacccgttcggcgggggccaacgcggccggcccgtgggctcggccgtggtactaaacgggtacccttaaccgttccccgtaactcgtcgtcctcgtcggacggtccgggacttcgggaccgg

SEQ ID NO: 433420 - DNA, 553 bp, Homo sapiens
  misc_feature: GZ8MTXP02FQ6B1.4.57.F02.1.454.CMB.2.raw
  modified_base (398)..(398): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagagccaggccaggcccctgtggtggtcgtccgttatgatagcgaccggccctcgagggatccccgtgagcgattcgtctggcctccaactcgtgggaaccacgggccaccctgaccatcagcgagggtcgaaggccgggganggacggccgactattacgtgtcgagggtgtaggggataggtaggtggtgatcatccatacgtcttacgggaacttcggggaacctaaggtcctaccggtcctaccgtcacgcccaacggcccaacccactcgtaccactctccgttcccctaccc

SEQ ID NO: 433421 - DNA, 577 bp, Homo sapiens
  misc_feature: GZ8MTXP02ITZH7.4.57.F02.1.454.CMB.2.raw
  modified_base (345)..(345): a, c, t, g, unknown or other
  modified_base (455)..(455): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagccgtgggggtccctgagactctcctgtgcagcgtctggattcgccttcagtgcctatggcatgcactgggtccgccaggctccaggcaaggggctggaatgggtggcagttatatggtttgatggaactaaacaaattctatgcagactccgtgaaggccgattcaccatctccagagacaatttcgagaacacattgaatctacagatgaacngtctgagagccgaggacacggctgtctattatgtgcgagagtaagtgtcatggttctttgaccaggtcggggaccgaacgggaacccgtgggtacctaccgtcgtcctcncgtccttccgaaccaacgggcccagtccggtcccttcccccgtcggcccgtccccgttcgccttacccgacggtacgccgtacccgttcggtcgggggaccaacggacggcccggtccccgg

SEQ ID NO: 433422 - DNA, 771 bp, Homo sapiens
  misc_feature: GZ8MTXP02IW5GE.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggccaggataacctgtgtgggaaccagcagtcggaagtaaagtgtacattggtacaggcagagccaggccaggcccctggtggtggtcgtcgtatgatagcgaccggcctcgacgggactcccgtaggcgcgtacttccgtactccgggtcctaccaacgttcgtacggggtaaaccaccggggtcccaccccgtagaaacccctagttacccgaagggtccggtaaacgggggttcccgggaaaacggggtccccgggggtaaagttcggggaacgggtacccgtaacgttacgtttaaacgtcgggttacggtaggggttacgggtagggggtaacttaagggttacgggttaggtacgggtacttaccgtaacgttacccgtaacgtttacccgggttacgtttaaccgggggtaaaccgttacgggggtaacccttaaaacggggttccccttacccggttacccgtaccggttaccgtaaacccggtaccccgaaaccgggtaccccaaaacccccgtacgtttcccggaccttaaccgtccccgttacgtttaccccccggtcccccg

SEQ ID NO: 433423 - DNA, 527 bp, Homo sapiens
  misc_feature: GZ8MTXP02G0TLH.4.57.F02.1.454.CMB.2.raw
  modified_base (352)..(352): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtgtcgtccgttatgatagcgaccggcctcagggatccctgacgcgattctctggctccaactctgggaaccncggccacctgaccatcagcagggtcaagccgggatggagcgactatactgtcaggtgtgggatagtagtggtgatcgatccatacgtcgttcggaactggggacctaagggtcctccgtcctacgtcacgcccgaacgcccaaacccgactcgtcacgtctacgtttcccgcccc

SEQ ID NO: 433424 - DNA, 555 bp, Homo sapiens
  misc_feature: GZ8MTXP02I3T9R.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctccagagacaatttcgaagaacacattgaatctacagatgaacagtctagagagccgaggacacggctgtctattatgtgcgagagtagtgtcagtggttctttgaccagtgggaccgacgggaaccctggtccaccgtctcctcacgtccttccacgaacgggcccacgttccggtccttcccccgtcggtcccgcccttcgccctaccgacggacgcccgaccgtcgtcgggggccacgcggccggtcccgg

SEQ ID NO: 433425 - DNA, 521 bp, Homo sapiens
  misc_feature: GZ8MTXP02IWOVP.4.57.F02.1.454.CMB.2.raw
  modified_base (226)..(226): a, c, t, g, unknown or other
  modified_base (296)..(296): a, c, t, g, unknown or other
  modified_base (359)..(359): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtgggaaccngcatcggaggtaaagtgtacattggtacaggcagaagccaggccaggcccctgtggtggtcgtccgttangatagcgaccggcccctcgagggatccccgtgagcgattcctctggctccaactctggggacncgggcccaccctgaccatcagcgagggtcgaagccgggggatggaggccgactattactgtcaggtgtgggatagtagtggtgatcatccatacgtctcggaactgggacaggtctccgtcctacgtcacgcccaaggcccaaactccactcgtcacttccg

SEQ ID NO: 433426 - DNA, 582 bp, Homo sapiens
  misc_feature: GZ8MTXP02F59O7.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactcgtgaaggccgattcacatctccagagactaatttcgaagaacacattagaaatctaacagatagaacagtactagaagacgccgaggacacggctgtacttattattgtgcgagagtaagtgtacattgttctttgacgaggtcggggaccgacgggaacccgtgtcctaccgtctcccgtcgacgccttacccacgaacgggccctacgttccggtcccttccccgcggcccgtcccgtcgcctcccgaggaaccgtccgtaccgtccggtacgggggaccaccggacggccccggg

SEQ ID NO: 433427 - DNA, 540 bp, Homo sapiens
  misc_feature: GZ8MTXP02HFY40.4.57.F02.1.454.CMB.2.raw
  modified_base (293)..(293): a, c, t, g, unknown or other
  modified_base (356)..(356): a, c, t, g, unknown or other
  modified_base (438)..(438): a, c, t, g, unknown or other
  modified_base (516)..(516): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggacaggcagaagccaggccaggcccctgtggtggtcgtccgttangatagcgaccggccctcgagggactccctgagcgattctctggcctccaactctagggaaccncggccacctgaccatcagcaggggtcgaaaggccggggatggacggccgactatactgtcagggtgtgggattagtaggtgngatcgatccattacgtcgttacggaacgtgggacctaagggtcctccggtcctacgtcacgcccaaggcccaacccgntcgtcactcctcgttccccacccc

SEQ ID NO: 433428 - DNA, 629 bp, Homo sapiens
  misc_feature: GZ8MTXP02H8E2A.4.57.F02.1.454.CMB.2.raw
  modified_base (173)..(173): a, c, t, g, unknown or other
  modified_base (215)..(215): a, c, t, g, unknown or other
  modified_base (223)..(223): a, c, t, g, unknown or other
  modified_base (254)..(254): a, c, t, g, unknown or other
  modified_base (257)..(257): a, c, t, g, unknown or other
  modified_base (297)..(297): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcagtcggcccagggcagacggccaggataacctgtgngggaaccngcagtcggaaggtaaagtgtacagttggacnggnagaagccaggccaggcccctggtggtgtacgtcgtactgntagcgaccggcctcgaggacgtccctgagcgatctctacggctaccactcgtcggaacgaccggcccaccctacgaccactaccacggactacgggaccggaacgggaccgggggacgtacggaacggggacccgtacgttacgttaacgttggtaccggtagggtgggtaggggtgttaaagggttagggttaggttcggagtacgtaactccgtaataccggttcgttaccggtaacgtacggggaacgtaacggtccgttccgtacctccgtacgaccgacccgaacgaccgaaccccactcgtctacctcctaccgttccctaccccc

SEQ ID NO: 433429 - DNA, 621 bp, Homo sapiens
  misc_feature: GZ8MTXP02GWLI5.4.57.F02.1.454.CMB.2.raw
  modified_base (306)..(306): a, c, t, g, unknown or other
  modified_base (333)..(333): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcaggacggccaggactaccgtgtgtacggaaccagcagtcggaaggtaaagtgtaacagttggtacaggcagacgccaggccacggccctggtggtggtcgtcgttangatcgcggacccgcctgaggactccgngacgcgtattccctcgtcgcctaccaacgttcgtacggggaccaccgggaccccacccgtcgaaccctagtaccgaacgcgacgggggtacgaacggggccggggagtacgggacggcccgtaattacgttaccgtggtcgtaaggggttcggtagggtagttagggtaggtggtagactcgtactctaagtccgttcgtacgggaacggtacggaccgtaggtcctccggtacctacgtacgaccgtacccaacggacctaaccgtccacgtcgtacctacttcccg

SEQ ID NO: 433430 - DNA, 561 bp, Homo sapiens
  misc_feature: GZ8MTXP02G2RLF.4.57.F02.1.454.CMB.2.raw
  modified_base (294)..(294): a, c, t, g, unknown or other
  modified_base (355)..(355): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggagtaaagtgtacattggacaggcagaagccaggccaggcccctgtggtggtcgtccgtangatagcgaccggcctcagggatcccctgagcgtattcctctggctccaactcgtgggaccncggccaccctgacccatcagcgaggggtcgaaagccgggggatggacggccggaactagttactgtacgagggtgtggggattaggtaggtggtgatcagtcagttacgtcgttacggaacgtcggggaaccaaggggttctacccggtccttacgtccgaacgtcccgaaacggcccaaaccgtcccaactcgtccacgtttccg

SEQ ID NO: 433431 - DNA, 548 bp, Homo sapiens
  misc_feature: GZ8MTXP02JTJ5R.4.57.F02.1.454.CMB.2.raw
  modified_base (457)..(457): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaagtgtacattggtacaggcagaagccaggccaggcccctgtggtggtcgtccgttatgatagcgacggccctcaggggatccctgagcgacttcctctggctacccaactccgtgggaccacgggcccaccctgaccatcagcgaggggtcgaaaggccgggggatggacggcccgacttatacgtgtcgagggtgtggggataggaggttgggngagtcagtccatcgtcttacgggaacgttcgggaccaaggtcctccgtcctacgtcacgacccaaggcccaactccactcgtccacttccg

SEQ ID NO: 433432 - DNA, 543 bp, Homo sapiens
  misc_feature: GZ8MTXP02HEJXV.4.57.F02.1.454.CMB.2.raw
  modified_base (283)..(283): a, c, t, g, unknown or other
  modified_base (308)..(308): a, c, t, g, unknown or other
  modified_base (349)..(349): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaagtgtacatggtacaggcagaagcaggccaggcccctgtggngtcgtcgtatgatagcgaccgcctnagggatccctgagcgtatcctctgctcaactctacgggacncggccaccctgaccatcagcagggtcgaagccggggatgacggccgactatacgtgtcgaggtgtgggattaggtagtggtagatcatcctagtaccgttcgttacggaacgtcgggaaccaaggtccctccgttaccctacgtaccacgacccgaacggcccaaaacgtccgaactcgtacctaacgttcccg

SEQ ID NO: 433433 - DNA, 541 bp, Homo sapiens
  misc_feature: GZ8MTXP02G9S02.4.57.F02.1.454.CMB.2.raw
  modified_base (338)..(338): a, c, t, g, unknown or other
  modified_base (365)..(365): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgagtagcgaccggcccgtcagggagtcctcgagcgatctctgcncactctggacgacgccaccctcgaccntcagcgaggtcgagacccggggagtggacggccgactacttactacgtcgaggtgtagggatagtgtaggtgatgatccatacgtcgttcgacgtacggaccgaacggtcgtcgtcctacgcacgacccgaacggacccaaccccgactacgtacacctctccgttcccttacccc

SEQ ID NO: 433434 - DNA, 530 bp, Homo sapiens
  misc_feature: GZ8MTXP02FR979.4.57.F02.1.454.CMB.2.raw
  modified_base (353)..(353): a, c, t, g, unknown or other
tcagagcactgtagcacgaccggtgctcgatttagctcgatatagttgggtttgggggaagaggaagactgacggtcctcccaggtgtccagtgtcaggtgcacctggtggagtcggggggaggcgtggtccagcctggggggtctctgagactctcctgtgcagcgtctggattcgccttcagtgcctatggcatgcactgggtccgccaggctccaggcaaggggctggaatgggtgcagttatatggtttgatggaactaacaaattctatgcagactccgtgaaggccgattcaccatctcagagacaattcgaagaacacattgaatctacagatgaacagtctgagngccgagacacgctgtcattatgtgcgagagtaagtggtcatgtctttgacctaggtgggacagggacctggtcaccgtctcctcagcttccgaaccacgggcccacgtccggtccttcccccgtggtcccgcccgttcgcctccgaaggacgcaccgtcgtcgggggccacgaccgg

SEQ ID NO: 433435 - DNA, 647 bp, Homo sapiens
  misc_feature: GZ8MTXP02J1C93.4.57.F02.1.454.CMB.2.raw
  modified_base (304)..(304): a, c, t, g, unknown or other
  modified_base (380)..(380): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccagcagtcggaaggtaaaagtgtacagttggacaggcaagaagccgaggccacggcccctgtggtggtcgtccgttangataggccgaccggccctgagggactcccgtgacgcgtattcccgtcgtggcctacccaacgtcgtacggggaccnccgggaccccacccgtgaacccatccgacgaccggtaggggtaccgaacggggcccggggaatcgggacgggaccctaacgttaacgttaccgtgtacgtagggttgggtagggtaagtaggtagggtgggtagtactcgtaacgtacccgtaagttaccgttaccgtacggaacgttcggggaacctacggtccgtacccgttaccgtaccgaccgaccgtacccgaacggtacccaacgtccctaagtccgtacctcgttacccg

SEQ ID NO: 433436 - DNA, 751 bp, Homo sapiens
  misc_feature: GZ8MTXP02IM88N.4.57.F02.1.454.CMB.2.raw
  modified_base (309)..(309): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtagggaaccagcagtacggaaggtaaaagtgtaacagttggtacaggcaagaagccaggccacggcccctggtggtcggtcgtccgttangatacgcgacccggccctgacgggactcccgtaggacgcgtattccctcgtcggcctaccaacttcgtacggggaccaccgggcccaccgtcgacccatcgacgcgaggggtaccgaacggggacccgggggatacggggacgggacccgtaacgttaacgttaaccgtggtaccggtagggttcgggtaggggtaagtttaaggggtaggttaggggtacgtacgttactacgttacccgtaaggtttaccggtttaccggttaaccgggggtaaaaccgtttcgggggaaaacccgtttaaaccgggggttcccctttaaccccggttaccccgtttaacccggaaccccgtaaccggtacccccggaaaaccggggttacccccaaaacccggtttacccccgaactttcccggtaaccgtttacccgttttacccccg

SEQ ID NO: 433437 - DNA, 554 bp, Homo sapiens
  misc_feature: GZ8MTXP02HSFP8.4.57.F02.1.454.CMB.2.raw
  modified_base (333)..(333): a, c, t, g, unknown or other
tcagagcactgtagcacgaccggtgctcgatttagctcgatatagttgggtttgggggcctaaggaagaagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaggtaaaagtgtacattggtacaggcagaagccaggccaggcccctggtggtggtcgtccgttatgatagcgaccggccctcgagggactccctgagcgattcnctggccctccaactcgtacgggaacaccggcccacccgtgaccatcagcgagggtcgaaagccgggatgaggccgacttagtactgtcagggtgtgggatagtgtggtgatcgatccattacgtcgttcggaactcgggacaagggtcctaccggtcctacgtacacgacccaacggaccccaacccaacgtcgaccacttctccgttcccctaccctccc

SEQ ID NO: 433438 - DNA, 546 bp, Homo sapiens
  misc_feature: GZ8MTXP02JIJ1K.4.57.F02.1.454.CMB.2.raw
  modified_base (359)..(359): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagccgaccggccctcgagggactcccgtgacgcgattcgctacggctccaactcgtgggaacncgccacctgaccatcagcgtagggcgaaggccggggatggaggccgactagttactgtcgaggtgtaggggataggtagttggagatcatccatcgtcttggactggacctaacggtctccggtacctacgtcgacgacccgaacggccaacccccagtacgtccaacgtccttcggtcccctcccc

SEQ ID NO: 433439 - DNA, 529 bp, Homo sapiens
  misc_feature: GZ8MTXP02IKAGP.4.57.F02.1.454.CMB.2.raw
  modified_base (297)..(297): a, c, t, g, unknown or other
  modified_base (335)..(335): a, c, t, g, unknown or other
  modified_base (357)..(357): a, c, t, g, unknown or other
  modified_base (373)..(373): a, c, t, g, unknown or other
  modified_base (432)..(432): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaagtgtacattggtacaggcagaagcaggccaggcccctgtggtggtctcgttangatgcgacggccctcgagggatccctgagcgacttccnctggctccaactcgtgggaccncggccacccgtgaccntcagcagggtcgaagccggggatgaggccgatatactgcaggtgtggatagtagtggtnatcatctagtcgtactacggaactgggacctaaagggtcttaccggtacctacggtacagacccaaaggcccaacgtcccacgtcgtaccacttccg

SEQ ID NO: 433440 - DNA, 540 bp, Homo sapiens
  misc_feature: GZ8MTXP02I0TV7.4.57.F02.1.454.CMB.2.raw
  modified_base (343)..(343): a, c, t, g, unknown or other
  modified_base (355)..(355): a, c, t, g, unknown or other
  modified_base (361)..(361): a, c, t, g, unknown or other
  modified_base (418)..(418): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgataggcgaccggccctcgagggatcccctgagcgtattcctcnggctccaactcngggacncggccacccgtgaccatcacgcgaggggtcaaggccgggggatggacggccgaactnttactgtcagggtgtgggataggtagtggtgagtcatcatacgtctacggacgtagggacctaaggtcgtccgtcctacgtacacgtacccaaggcccaacgtccactcgtacctacttccg

SEQ ID NO: 433441 - DNA, 509 bp, Homo sapiens
  misc_feature: GZ8MTXP02JZBB2.4.57.F02.1.454.CMB.2.raw
  modified_base (274)..(274): a, c, t, g, unknown or other
  modified_base (324)..(324): a, c, t, g, unknown or other
  modified_base (335)..(335): a, c, t, g, unknown or other
  modified_base (340)..(340): a, c, t, g, unknown or other
  modified_base (346)..(346): a, c, t, g, unknown or other
  modified_base (349)..(352): a, c, t, g, unknown or other
  modified_base (364)..(364): a, c, t, g, unknown or other
  modified_base (366)..(366): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacgcaggataacctgtgtggaaccagcatcggaggtaaaagtgtacattggtacaggcagaagccagcagccccngtgtgcgtcgtatgatagcgaccggccctcagggatccctgagcgattcnctgctcaatcnggacncgcacnacnnnnagagagcggagngngacacatactgtgagtgtaggagtagtagtaggtagatactactacacgtacgtacgtacgtaacgtacggtacgaacggtacgtaccgtaccgtaccgtacgaacgaccgaacgaccgaacctacctactacgtactactcg

SEQ ID NO: 433442 - DNA, 561 bp, Homo sapiens
  misc_feature: GZ8MTXP02G3HBP.4.57.F02.1.454.CMB.2.raw
  modified_base (173)..(173): a, c, t, g, unknown or other
  modified_base (360)..(360): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcagtcggccccagggcagacggccaggataacctgtgtgggaaccagcagtcggaaggtaaaagtgtacattggtacaggcagaagccaggccaggcccctgtggtggtcgtccgtatgatagcgaccggcctcaggggactccctggagcgattctctaggcctccaactctggggaaccncgggccaccctgaccatcagcgacgggtcgaaaggcccggggatggacgggcccgaactacttaacgtgacgagggtggtagggataggtaggtggtgatcgatccatacgtcttacggatcgggaactaggtctccgtctacggtctacgacccgaacggcccaacccgactcgtaccactccttcgtacccctaccccg

SEQ ID NO: 433443 - DNA, 577 bp, Homo sapiens
  misc_feature: GZ8MTXP02I6VB4.4.57.F02.1.454.CMB.2.raw
  modified_base (429)..(429): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaagtgtacattggtacaggcagaagccaggccaggcccctgtggtggtcgtccgttatgataggcgaccggccctcgaggggactccccgtgacgcgattcctctggctccaactcgtagggacaccggcccaccctcgaccatcagcgagggtcgaagccgggggatggaggcccgactattaacgngtacgaggtggtggggattaggtagtgggttagagtcgatcccaagttaccgtcgttacggaacgttcggggacctaaagggttccctaccggttccctaccgtccgacgaccccgaaggccccaacgtccactcgtccactttcccg

SEQ ID NO: 433444 - DNA, 582 bp, Homo sapiens
  misc_feature: GZ8MTXP02GU0A0.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaaagtgtacagttggtacaggcagaagccaggccaggcccctgtggtggtcgtcgttatgatagcgacccggcctcgagggactccctgacgcgattctctcggctccaactcgtagggaaccacggccaccctgaccatcagcaggggtacgaaggccggggatggacggccgtactattacgtgtacgtaggtggtagggagtaggtaggtggtgatcatccagttacgtcgttacggaacgtcggggaacctaacgggtccctaccggtccctacgtccgaaccgcccaaacggccccaaacccgtcgtacgtccaaccgtcctaccgttacccctaccccc

SEQ ID NO: 433445 - DNA, 517 bp, Homo sapiens
  misc_feature: GZ8MTXP02G3NK5.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccattcaccatctccagagacaatttcgagaacacattgaaatctaacagatagaacagtctgagagccgagacacggctgtctatatgtgcgagagtaagtgtcagtgtctttgacaggtgggcaggacctgcacgtctctcagctccaccacggcccagtccggtcctcccgtcggccgccctcgcctccgaggcgccaccgtcgtcggggcacgacgcccgg

SEQ ID NO: 433446 - DNA, 671 bp, Homo sapiens
  misc_feature: GZ8MTXP02H2JIQ.4.57.F02.1.454.CMB.2.raw
  modified_base (177)..(177): a, c, t, g, unknown or other
  modified_base (213)..(213): a, c, t, g, unknown or other
  modified_base (324)..(324): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctnagtgtcagtcggcccaggcagacgcaggataactgngtaggaaccagcagtcggaaggtaaaagtgtacagttggtacaggcagacgcgaggccaggcccctggtggtgtcgtccgttatgataggccgaccggccctgagggtacnccgtagacgcgattcctcgtcggctccaactcgtaggaccaccggaccacccgtgaccatcacggacgaggggtacgaacgggccggggatacgggacggaccggtaacttaacgttaactggtacgtaggggttaggtaggggtagtttagggtaagtgggggtagtataccgtacgttaccgaacgttaccgttaccgtttaccggggaaacgtttacggggaaaccgttaacggggttacccgttacccggttaccgtttaccggacccgtaaccggaccccgaaacgggtaccctaaaacccggtacccctaacgttccggttaccctaaccgtttcccccgg

SEQ ID NO: 433447 - DNA, 575 bp, Homo sapiens
  misc_feature: GZ8MTXP02F8WE7.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccagcagtcggaaggtaaaagtgtacagttggtacaggcagaagccgaggccaggcccctgtggtggtcgtcgtatgatagcgaccggcctcgaggactcccgtgacgcgtattcctcgtcggctaccaactcgtagggaccaccggcccacccgtgacccatcgagcgacgggtacgaacggccgggggatggacggcctacgtagttacgtgtacgtagggttgtaggggattaggtaggtgggtagactcgactcgaacgttcggtcgtacggaacgtcgggacctaagggtcctccgtaccgtacgtcacgacccgtaagcccaactccgactcgacctacttcccg

SEQ ID NO: 433448 - DNA, 549 bp, Homo sapiens
  misc_feature: GZ8MTXP02F905H.4.57.F02.1.454.CMB.2.raw
  modified_base (274)..(274): a, c, t, g, unknown or other
  modified_base (288)..(288): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagagcaggccaggccctgnggtgtcgtcgttangatagcgaccggccctcagggactcccgtgagcgattctctcggctccaactctggggaaccacgggcccaccctgaccatcagcgagggtcgaaggcccggggatggacggccgtactattactggtcagggtgtaggggataggtagtggtagatcgactcatacgtcttaggaactgggaacctaagggtcctccgtcctacgtcacgacccaacggcccaaaccccgactacgtccactcctcgttccccctacccc

SEQ ID NO: 433449 - DNA, 692 bp, Homo sapiens
  misc_feature: GZ8MTXP02HIP90.4.57.F02.1.454.CMB.2.raw
  modified_base (228)..(228): a, c, t, g, unknown or other
  modified_base (303)..(303): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcagtcggaaggtaaaagtgtacagttggtacaggcagaagccaggccacggcccctgtggtggtcgtccgttangataggcgaccggccctcgagggactccctgacgcgtattcctcgtggcctcctaactcggtagggaccgaccgggtcccaacccgtcgacccagtccgacggaccgtaaggggtccggaaagggcccgggggaatcgggacggacccgtaacgttaacgttaaccgtggtaccgtaaggggttgggttaggggtaactttaggggtaagggttcggggttaagtacgttacgtaacgttaccgtaacggttaccggttacggttaacgggaaccggtacggggtaaccgtacgggttcccgttacccggttaccgtaccgtaccgaacccggaacccggaaccggtaccctaaaccgtcccgtaacgttccgtaccttaccgttcccg

SEQ ID NO: 433450 - DNA, 662 bp, Homo sapiens
  misc_feature: GZ8MTXP02F1HLM.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagaagccaggccaggcccctgtggtggtcgtccgttatgatagcgaccggcctcgagggactccctgagcgattcctcgtggctaccaaactccgtagggaccaccggtcccaccctgaccatcgagcgagggtcgaagggccggggatcggaacggccgtactacttacgtgtcgtaagggttggtagggtaagttaggtagggttgggtaagtaacgttcgaacttacccgtaaagttaccggttacgttaccgggtaaaacggtaccgggggtaaccgtaaacggggttccccgtacccggttacccgttaccggttaccgaccggaacccccgaaaacgggtacccccgtaaaaccttacccgaaccgtttacggtaaccctacgtttacccccg

SEQ ID NO: 433451 - DNA, 573 bp, Homo sapiens
  misc_feature: GZ8MTXP02GH1YP.4.57.F02.1.454.CMB.2.raw
  modified_base (296)..(296): a, c, t, g, unknown or other
tcagagcactgtagcacgaccggtgctcgatttagctcgatatagttggggtttggggggcctaaggaagcagcactggtggtgcctcagccatggcctggaccgttctcctcctcggcctcctctctcactgcacaggctctgtgacctcatatgtgctgactcagccaccctcagtgtcagtcggcccagggcaggacggccaggataacctgtgtgggaaccagcagtcggaaggtaaaagtgtacattggtacaggcagagcaggccaggccctgtggtggtcgtccgttangatagcgaccggcctcgagggactcccgtgagcgtattctctcggctccaactcgtaggggaaccacggcccaccgtcgaccatacaggcgaggggtacgaacggcccgggggatcggacggcccgtactacgttactgtacgaggtggtagggtataggtaggtggtagattcactcattacgtcgttacggacgtcgggacctaacggtcctccgtccgtacgtcacgacccgaacggccccaacccgtctacgtctactctccgtcccgtcccc

SEQ ID NO: 433452 - DNA, 543 bp, Homo sapiens
  misc_feature: GZ8MTXP02H4PDQ.4.57.F02.1.454.CMB.2.raw
  modified_base (413)..(413): a, c, t, g, unknown or other
  modified_base (513)..(513): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccaggggcagacggccaggataacctgtgtgggaaccagcatcggaggtaaaagtgtacattggtacaggcagaagccaggccaggcccctgtggtggtcgtccgttatgatagcgaccggcctcgacgggatccctgagcgattctctcggctccaactctgggaacacgggccacctgaccatcagcagggtcgaagccgggggatggacggccgactagttacngtcgaggtgtgggatgtagtggtgatcgatccatacgtcttcggaactcggggaccaaggtctccgtcctacgtcacgccccgaaaggccctaaaccccncgtacgtccactcctcgtttaccccacccc

SEQ ID NO: 433453 - DNA, 524 bp, Homo sapiens
  misc_feature: GZ8MTXP02HJ783.4.57.F02.1.454.CMB.2.raw
  modified_base (306)..(306): a, c, t, g, unknown or other
  modified_base (317)..(317): a, c, t, g, unknown or other
  modified_base (345)..(345): a, c, t, g, unknown or other
  modified_base (382)..(382): a, c, t, g, unknown or other
  modified_base (397)..(397): a, c, t, g, unknown or other
  modified_base (433)..(433): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatagtggtttgatggaactaacaaattctatgcagactccgtgaaggccattcacatctccaganacaatttcganaacacattgaatctaacagatagaaacngtctagagagccgaggacacggctgtactattattgngcgagagtaagtgtnatgtctttgacagtggcaggacctggtcacgtctcncacgctccacacggccagtccgtcctccccgtggccgccctcgcctccgacggcgccgaccgtcgtcgggggcaccgacggccggtcccgg

SEQ ID NO: 433454 - DNA, 569 bp, Homo sapiens
  misc_feature: GZ8MTXP02HQFHL.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagacggccaggataacctgtgtgggaaccagcagtcggaaggtaaaagtgtacattggtacaggcagaagccaggccaggcccctgtggtggtcgtccgtatgatagcgacccggcctcgagggactcccgtgagcgtattctctcggcctccaactccgtagggaaccacgggccaccctgaccactcgagcgagggtcgaaggccggggatcggaggcccgtatattacgtgtacgaggtgtagggatagtagtaggtgatcatccatacgtcttaggactgggaacctaggtccttaccgtcctaacggtccacgacccgtaacggccccaaacccgctccgtcaccttcctccgttcccctaacccccg

SEQ ID NO: 433455 - DNA, 560 bp, Homo sapiens
  misc_feature: GZ8MTXP02GE0QI.4.57.F02.1.454.CMB.2.raw
  modified_base (308)..(308): a, c, t, g, unknown or other
  modified_base (353)..(353): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaagggggctgggaagtggggtggctagttatagttggtttgataggaaactaacaaattctatgcagactccgtgaaggccatcacatcncagagactaattcgagaacactattagaatcaacagatacgaacngtctagagacgacgaggacacggtctagtctagttatgtagcgaagagtagtgtctagtgttctttgacgagtcgggacgacggaaccgtggtacctaccgtctccgtcagtcttcccaacgacggcccagtccggtccttccccgtggcccgtcccgtcgcctccgagacgccgtaccgtcggcggggacacggacgccggtcccg

SEQ ID NO: 433456 - DNA, 576 bp, Homo sapiens
  misc_feature: GZ8MTXP02HGUW0.4.57.F02.1.454.CMB.2.raw
  modified_base (216)..(216): a, c, t, g, unknown or other
  modified_base (293)..(293): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgngggaacagcagtcggaggtaaaagtgtacagttggacaggcagaagccaggccaggcccctgtggtggtcgtcgtangatagcgacccggccctgacgggactcccgtgagcgattctctcggctccaactcgtagggaaccaccgggcccacccgtgacccatcacgacagggggtcgaaaggccgggggatgggacggcccgaacttacgttacgtgtcgagggtggtagggtataggtaggttggtagattcgatccaagttacgtcgttacggaacgtgggaacctaacggtcctaccgtaccgtacgtcacgcccgaacggcccaaccccgatcgacacctctccgtccctcccc

SEQ ID NO: 433457 - DNA, 531 bp, Homo sapiens
  misc_feature: GZ8MTXP02GULDK.4.57.F02.1.454.CMB.2.raw
  modified_base (222)..(222): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacgccaggataacctgtgtgggaaccngcatcggaggtaaagtgtacattggtacaggcagaagccaggccaggcccctgtggtggtcgtccgttatgatagcgaccggccctcgagggactcccgtgacgcgattctctcggctccaactcgtgggaaccacgggccaccctgaccatcagcaggggtcgaaggccggggatggacggccgactattactgtcaggtggtagggataggtagtggtgatcagtccatacgtctacggactgggaccaggtcctccgtcctacgtcacgcccaagcccaacccgctcgtcactctcgtccctaccc

SEQ ID NO: 433458 - DNA, 549 bp, Homo sapiens
  misc_feature: GZ8MTXP02GKDHT.4.57.F02.1.454.CMB.2.raw
  modified_base (385)..(385): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaaactaacaaattctatgcagactccgtgaagggccgattcaccatctccagagacaatttcgagaacacattgaatctacagatgaaacagtctgagagccgagacacggctgtctattattgngcgagagtagtgtcatgtctttgaccagtggggcagggacctggtcaccgtctccgtcacgtcttaccaccgaacgggccctacgtccggtcccttcccccgtcggcccgtcccgtcgcctaccgacggaacgccaccgttcggcgggggcaccgacggcccgg

SEQ ID NO: 433459 - DNA, 626 bp, Homo sapiens
  misc_feature: GZ8MTXP02GA4R7.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcgggaaggtaaagtgtacagttggtacaggcagaagccaggccaggcccctgtggtgtcgtccgttatgatagcgaccggccctcgagggactcccgtgacgcgattctctcggcctccaactcgtacgggaaccacgggcccacccgtagacccatccaagcgaaggggtaccgaacggccggggatacggacggacccgtataacttacgtggtcgagggtgtagggtaataggtaggtggtaggtactcgaactccgaagttccgttacgttaccgggaacgttacggggaacctaacgggtccctacccggttaccgtaccgtacgaccgaccccgaacggacccccaaacccacgtcggtacccacgttccgtcccgtacccctaacccccg

SEQ ID NO: 433460 - DNA, 609 bp, Homo sapiens
  misc_feature: GZ8MTXP02GD19R.4.57.F02.1.454.CMB.2.raw
  modified_base (224)..(224): a, c, t, g, unknown or other
  modified_base (299)..(299): a, c, t, g, unknown or other
  modified_base (606)..(606): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcagtcggaaggtaaaagtgtaacagttggtacaggcagaagccaggccaggcccctgtggtggtcgtccgttangatagcgaccggccctcagggatccctgagcgattctctcggcctccaactcgtaggggaaccacgggcccacccgtgaccatccaaggccgaggggtccgaaaggcccgggggatcggacggcccgtaactacgttacgtgtcgaggggttgtaggggtataaggttaggtgggtagattcgaattcccgaattaccggttacttcgggaaacgttcggggaacctaacgggtccctacccgtacctaacggtccacgccccaaacggacccaaacccacgtcgtccacttcctccgtttcccccnccc

SEQ ID NO: 433461 - DNA, 476 bp, Homo sapiens
  misc_feature: GZ8MTXP02IQXXP.4.57.F02.1.454.CMB.2.raw
  modified_base (211)..(211): a, c, t, g, unknown or other
  modified_base (213)..(213): a, c, t, g, unknown or other
  modified_base (219)..(219): a, c, t, g, unknown or other
  modified_base (245)..(245): a, c, t, g, unknown or other
  modified_base (251)..(251): a, c, t, g, unknown or other
  modified_base (264)..(264): a, c, t, g, unknown or other
  modified_base (274)..(274): a, c, t, g, unknown or other
  modified_base (277)..(277): a, c, t, g, unknown or other
  modified_base (284)..(284): a, c, t, g, unknown or other
  modified_base (289)..(289): a, c, t, g, unknown or other
  modified_base (291)..(291): a, c, t, g, unknown or other
  modified_base (293)..(294): a, c, t, g, unknown or other
  modified_base (296)..(296): a, c, t, g, unknown or other
  modified_base (299)..(299): a, c, t, g, unknown or other
  modified_base (302)..(302): a, c, t, g, unknown or other
  modified_base (308)..(308): a, c, t, g, unknown or other
  modified_base (314)..(314): a, c, t, g, unknown or other
  modified_base (318)..(318): a, c, t, g, unknown or other
  modified_base (320)..(320): a, c, t, g, unknown or other
  modified_base (323)..(323): a, c, t, g, unknown or other
  modified_base (325)..(325): a, c, t, g, unknown or other
  modified_base (341)..(341): a, c, t, g, unknown or other
  modified_base (355)..(355): a, c, t, g, unknown or other
  modified_base (357)..(357): a, c, t, g, unknown or other
  modified_base (377)..(377): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcgccccaggcagacgcaggatactgngnggaacngcatcggaagtaaagtgtacatgacngcagancagcagcctgtgngtctcgttangangcgcgcngagcncngnntntcntcnctacancgagcncgcncnacnangcgagacgacgcggancgacgactatatgngngagtggagtagtagtgtganacactactacgtacgtacgtacgtacgtacgtacggtacgtacgtcgtaccgtaccgtacgtacgacgaccgaaccgaccacctacactactactactc

SEQ ID NO: 433462 - DNA, 580 bp, Homo sapiens
  misc_feature: GZ8MTXP02II2FF.4.57.F02.1.454.CMB.2.raw
  modified_base (297)..(297): a, c, t, g, unknown or other
  modified_base (480)..(480): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtgggaaccagcatcggaggtaaaagtgtacattggtacaggcagaagccaggccaggcccctgtggtggtcgtccgttangatagcgaccggccctcgaggggactccccgtgacgcgtattccctacgtggcctacccaacttccgtacggggaaccaccgggccccaaccccgtgacccccaagtccaagcgaggggtcgaaggcccgggggataggacggcccgatattactgtcaggtgtagggagtaggtagtgggtnagtcgatcgtaagtacgttcgtacggactacgggacctaaggtcctaccgtacctacgtaccacgtacccaacggacccaacgtccactcgtacactccg

SEQ ID NO: 433463 - DNA, 690 bp, Homo sapiens
  misc_feature: GZ8MTXP02ICNL3.4.57.F02.1.454.CMB.2.raw
  modified_base (226)..(226): a, c, t, g, unknown or other
  modified_base (300)..(300): a, c, t, g, unknown or other
  modified_base (541)..(541): a, c, t, g, unknown or other
tcagagcactgtagcacgaccggtgctcgatttagctcgatatagttgggtttggggctgggcctaaggaagcagcactgggtggtgcctcagccatggcctggaccgttctcctcctcggccctcctctctcactgcacaggctctgtgacctcatatgtgctgactcagccaccctcagtgtcagtcggcccagggcagacggcaggataactgtgtaggaacngcagtcggaaggtaaaagtgtaacagttggacaggcagaagccgaggccaggcccctgtggtggtcgtcgttangatagcgaccggcctgaggggactccccgtaggaacgtcgtactttcccgtcgtcggcctacccgaaacgtttccggaacggggaacccacccggggtacccacccccgtagaaccccacgtccaacggcccggaaacgggggtaccgaaacgggggcccgggggaatcggggacgggacccggtacttaacgttaccgtggtacgagggttggtagggaagtttaggtaggtcgggttanacgtacgtactaccgtaagttaccgtcgttaacgggaaccgttcggggaaaccctaacgggttccttacccgggtaccttaaccggaccgtacccgacccggtaaacggacccctaaccgtccgaaccgttcgaaccttaccgttcccg

SEQ ID NO: 433464 - DNA, 550 bp, Homo sapiens
  misc_feature: GZ8MTXP02I38UD.4.57.F02.1.454.CMB.2.raw
  modified_base (344)..(344): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctcagagacaatttcgaagaacacattgaatctacagatgaacngtctgagagccgaggacacggctgtctattattgtgcgagagtaagtggtcagtggttctttgaccgagtgggccgacgggtaaccctcggtcaccgtcgtcctcagcttccgaccgaacgggcccacgtccggttccttcccccgtcggccgtccctcgcctccgacggacgccgaccgtcgtcgggggcacgacgcggtcccgg

SEQ ID NO: 433465 - DNA, 570 bp, Homo sapiens
  misc_feature: GZ8MTXP02I1SJT.4.57.F02.1.454.CMB.2.raw
  modified_base (216)..(216): a, c, t, g, unknown or other
  modified_base (223)..(223): a, c, t, g, unknown or other
  modified_base (464)..(464): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggccccagggcagacggcaggatactgtgnggaaccngcagtcggaaggtaaagtgtacattggacaggcagaagccaggccacggcccctggtggtggtcgtcgttatgatcgcgaccggcctcgagggactcccgtgacgcgtacttcctcgtggcctaccaactcgtagggaccgccgcccaccctgaccatcgagcgagggtcgaaggccggggatcggaggccctaacgtacttacgtgtacgagggtggtagggaagtaggtaggtgggtanacgtcatctagtacgttcgtacggacgtacggacgtacggtccgtaccgtaccgtacgaccgacgacccgaacgaccctaacctcctacgtcgtacctaccgtccg

SEQ ID NO: 433466 - DNA, 635 bp, Homo sapiens
  misc_feature: GZ8MTXP02HJBTJ.4.57.F02.1.454.CMB.2.raw
  modified_base (227)..(227): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataaccgtgtgtagggaaccngcagtcggaaggtaaagtgtacagttggacaggcagaagccgaggccacggcccctggtggtggtcgtcgttatgatagcgaccgcctcgagggactcccgtgagcgtattctcgtcggcctaccgaactcgtacgggaaccaccgggcccacccgtagacccataccgagaccgagggggtaccgaacgggcccgggggatggggacggaccgtaacgttacttacgttggtacgaggggttggtaggggattaggtagggttggtgagttcaacgttcctagtaaccgttcgttaccgggaacgtacgggaaccgtaaacggttccgtacccgtaccgtacggtacaccggacccaacggaccccaacccgctacgtccaccgttcctacccttaccccctacccc

SEQ ID NO: 433467 - DNA, 585 bp, Homo sapiens
  misc_feature: GZ8MTXP02G1QKW.4.57.F02.1.454.CMB.2.raw
  modified_base (301)..(301): a, c, t, g, unknown or other
  modified_base (306)..(306): a, c, t, g, unknown or other
tcagagcactgtagcacgaccggtgctcgatttagctcgatatagttgggtttgggggaagaggaagactgacggtcctcccaggagttcaggtgctgggcaccgtgggcagtgggggaggcgtggtccagccgtgggggtccctgagactctcctgtgcagcgtctggattcgccttcagtgcctatggcatgcactgggtccgccaggctccaggcaaggggctgggaatggggtggcagttatagtggtttgatggaactaaacaaattctatgcagactcgtgaaggcatcacatcncaganactattcgagaacacattagaatactacagatagaacagtcagagagcgaggacacggctgtacttaattatgtgacgagtaagtaagtggtctagtcggttctttaggaccgtaggtcggggaccgacgggaacccgtggtaccgtaccgtcctaccgtctacgtccttacccgaaccgaacggtacccctacgtccggttcccttcccccgtggcccgtcccgtcgccgtaccgacgacgcgacccgtcgtacggggccaccgacggccggtcccgg

SEQ ID NO: 433468 - DNA, 651 bp, Homo sapiens
  misc_feature: GZ8MTXP02HBYFL.4.57.F02.1.454.CMB.2.raw
  modified_base (174)..(174): a, c, t, g, unknown or other
  modified_base (219)..(219): a, c, t, g, unknown or other
  modified_base (249)..(249): a, c, t, g, unknown or other
  modified_base (293)..(293): a, c, t, g, unknown or other
  modified_base (377)..(377): a, c, t, g, unknown or other
  modified_base (509)..(509): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccacctnagtcgtcaggtcggcccgaggcagacgcagatactgtgacggacngcagtaggaagtaaagtgtacagttggacnggacagaacgcgacggccacggccgtggtggtcgtcgtcgtagngacgtcgccgaccgcctaggacggtacctccgtgacgtcgtacttcgtacgtccgtacctaccgtaacgtcggaacggaacccncccggtcccacccgtagacctagccgacggcgggtacggggacggaacggggccggggatacggggacgtacccgttaagttaacgttcggtcgggtagtaggggttaggtagggtattaagggtgtaggtnacgtactacgtcgacggttaccgtcggtacggaaggtaccgaacgtacgttcccgtccgtacgtaaccggcctaacccgaaccccgacggaaccccctaactcgtaccgttcccacgttcccgttacccgtaccccctcccg

SEQ ID NO: 433469 - DNA, 562 bp, Homo sapiens
  misc_feature: GZ8MTXP02F7V8T.4.57.F02.1.454.CMB.2.raw
  modified_base (470)..(470): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaaagtgtacattggtacaggcagaagccaggccacggcccctgtggtggtcgtccgttatgatagcgacccggcctcgaggactcccctgagcgtattccgtctcggctccgaactcgtagggaccaccgggcccaaccctcgaacccatcgacgacgagggtcgaaacggccgggggatgacggccgaactattactgtactagggtggtgggataggtagtgggtanagtcatccgatcggtacgttcggaacgtcgggacctaaggtcctaccgtctacgtacacgaccaaggcccaacgtcccactcgcacgttccg

SEQ ID NO: 433470 - DNA, 516 bp, Homo sapiens
  misc_feature: GZ8MTXP02IF6ER.4.57.F02.1.454.CMB.2.raw
  modified_base (226)..(226): a, c, t, g, unknown or other
  modified_base (357)..(357): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaacngcatcggaggtaaaagtgtacattggtacaggcagaagccaggccaggcccctgtggtggtcgtccgttatgatagcgaccggccctcaggggatcccctgagcgattcctctggctccaactctgggacncggccaccctgacccatcagcgagggtcgaaagccgggggatggaggccgatatactgcaggtgtgggatagtagtggtgagtcatccatacgtctcggaactcgggacaaggtctaccggtctacgtcagcccaaggccaactccactcgtcactccg

SEQ ID NO: 433471 - DNA, 625 bp, Homo sapiens
  misc_feature: GZ8MTXP02HGKR8.4.57.F02.1.454.CMB.2.raw
  modified_base (296)..(296): a, c, t, g, unknown or other
  modified_base (311)..(311): a, c, t, g, unknown or other
  modified_base (375)..(375): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaaggggctggaatgggtgcagttatatggtttgatggaactaacaaattctatgcagactcgtgaaggcatcacatcncagagacaattcganaacatattgaatctacagatacgaaactagtctagagacgcgaggacacggctgtctatattgngcgagagtaagtgtactagttcggttcctttggaccgtaggtcggggacctaacggggtaacccgttcggtaccgaccggttcctacccgtcgacgtcccttacccgaaccgaacggggcccctaagttcccggttcccttccccccggtgggtccccgtcccccgttggtccccgtacccgacgggaccgaacccgtaacccgttccgggtccgggggacccaaccggaccgggtccccggtccccggg

SEQ ID NO: 433472 - DNA, 651 bp, Homo sapiens
  misc_feature: GZ8MTXP02GGUVF.4.57.F02.1.454.CMB.2.raw
  modified_base (218)..(218): a, c, t, g, unknown or other
  modified_base (290)..(290): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggcaggatactgtgtggaacngcatcggaaggtaaagtgtacattggtacaggcagaagccaggccaggcccctggtggtggtcgtccgttangatagcggacccggccctcgagggactcccgtgagcgattctcgtcggcctacccaactccgtagggaaaccaccgggcccacccgtgaaccactcgacgcgacggggtacgaaacggcccgggggatcgggaacggcccgtaactacgttaacgtggtacgagggtggtaggggattaggtaggtggtagtacgttacaacgttccgtaagttaccgttaccgttacgggaaacgttcggggaaacccctaaaggggttcccttacccggtaccgttaaccggtaccgaaccggaccccgaacggacccccaaaaccccgctacggtaccaccgttcctaccggttccccctaacccccg

SEQ ID NO: 433473 - DNA, 626 bp, Homo sapiens
  misc_feature: GZ8MTXP02F82GX.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccaggcagacgcaggatacctgtgtggaaccagcagtcggaaggtaaaagtgtaacagttggtacaggacagaagccaggccacggcccctggtggtcggtcgtcgttatgatacgcgacccggcctcgagggactcccgtgacgcgtacttcgtcgtcggcctacccgaacgtcgtacggggaaacctccgggccccaacccgtcggaaccactccgagccgaggggtaccgaacggcccggggatggaccggccgtaacttagttacgtagtacgagggtggtagggtagttaggtaggtggtagatcactccgtattacgttcgttacggaacgtcgggaacctaacggttccctccggtacccgtacgtccgaccgacccgaaccggaccccaaacccgcgtacgtaccaccgtcctaccgttacccctaccccg

SEQ ID NO: 433474 - DNA, 650 bp, Homo sapiens
  misc_feature: GZ8MTXP02IIYRZ.4.57.F02.1.454.CMB.2.raw
  modified_base (205)..(205): a, c, t, g, unknown or other
  modified_base (316)..(316): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaaggggctggaatgggtggcagttatatggtttgatggaactaacaaattctatgcagactcgtgaaggccatcaccatctcagagactaattcgaanaacactattagaatctaacagatacgaaacagtctagagacgaccgagggacaacggtctgtacttattattgtgcgagagtaagtggtactagttcggttctttagaccgtagggtcggggacccgtaaacggggtaaacccgttcgggttaccgtacccggttccgttaccccgttacgaccgtacctttacccgaacccggtaaacgggtcccctaacgttcccggttcccgtttcccccgtcgggcccgtaccccgtcggtcccgtaccgaacggacgtaaccgtacccgtccggtacgggggacctaccggaacggtcccggtccccgg

SEQ ID NO: 433475 - DNA, 551 bp, Homo sapiens
  misc_feature: GZ8MTXP02FOJEN.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtaacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcgagggatccctgagcgtattctctggcctccaactctgggaacaccggccaccctgaccatcagcaggggtcgaaagccggggatggacggccgactatactgtcgaggtgtgggatagtagtggtgatcgatccatacgtcgttacggacgtgggacctaaggtctcccgtacctacgtcacgacccaacggccccaaaccccaacgtcgtaccaccttcgtccgtccccgcccttccc

SEQ ID NO: 433476 - DNA, 825 bp, Homo sapiens
  misc_feature: GZ8MTXP02F90EE.4.57.F02.1.454.CMB.2.raw
  modified_base (308)..(308): a, c, t, g, unknown or other
tcagagcactgtagcacgaccggtgctcgatttagctcgatatagttgggtttggggctgggcctaaggaagcagcactggtggtgcctcagccatggcctggaccgttctcctcctccggccccctctctcactgcacaggctctgtgacctcatatgtgctgactcagcccaccctcagtgtcagtcggccccagggcagacggccaggactaacctgtggtgggaaccagcagtcggaaggtaaaagtgtacattggtacaggcagaagccaggccacggcccctggtggtggtcgtccgttagngatagccgaccggcctcgagggactcccgtgacgcgtattctccgtggcctaccaactcgtacggggaacctaccgggcccaaccccgtacggaaccctaacgttaccgaaacgggaccggtaaacgggggtaccggaaaacggggtcccggggggaaagtacggggaaaccgggggtaccccgtaaaccgtttaacgtttaaaccggttcgggtaccggtaagggggttaggggttaagggggaaagtttaacggggttaaaggggttcggggttaagggtaaacttacccggtaacttacccgtaaacgtttaacccggtttacccggttaaccggggtaaaaccggttacccgggggtaaaacccggttaaaacgggtttccccggttaccccgggtttacccgttaacccgggttaccgtaaacccggtacccccgaaaaccgggaaccccctaaaacccggtacccctaaccgtttcgtaacccggtaaccctttacccgtttccccccggg

SEQ ID NO: 433477 - DNA, 704 bp, Homo sapiens
  misc_feature: GZ8MTXP02JEDDF.4.57.F02.1.454.CMB.2.raw
  modified_base (245)..(245): a, c, t, g, unknown or other
  modified_base (284)..(284): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacgcaggatactgtgtggaaccagcatcggagtaaagtgtacattggtanaggcagaagccaggccaggcccctgtggtgtcgtcgtangatgcgaccgcctcgagggactccctgacgcgattctcgtcggctaccaactcgtacgggaaaccaccgggcccaccccgtagacccatccgacggcgtacgggggtacgaaacgggcccgggggaatcgggaacgggaccccgtaattacgttaaccgtggtaccgaggggttggtaggggaagtttaagggtaaggtggggtagagttaccgaacttaccgtaacgttaccggttacgtttaccggggaaaacgttcgggggaaaacccgtaaacggggttcccttacccggttacccgttaaccggttacccgaaccggtaaccccccgtaaaacggggaccccccaaaaccccccgactttacccgggtaccctaacccttcccgtttacccggttaccccccccttaaccccccg

SEQ ID NO: 433478 - DNA, 610 bp, Homo sapiens
  misc_feature: GZ8MTXP02I3LJN.4.57.F02.1.454.CMB.2.raw
  modified_base (349)..(349): a, c, t, g, unknown or other
  modified_base (352)..(352): a, c, t, g, unknown or other
  modified_base (384)..(384): a, c, t, g, unknown or other
tcagagcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactcgtgaaggccattcaccatctcagagactaatttcgagaacactattgaatctaacagatcgaaacagtcnganacgccgaggacacggctgtctaatttatgtgngaagaagtaagtggtactaagttcggttaccttttgaacccgtagggttcggggaccgaacggggtaaacccttgggtcctaacccggttctacctcgacgtaccttcccgaaccgaaacgggccccaagtcccgggttcccttcccccgtggccccgtcccttcgcccttaccgacgggaacccgtccgtaccgtcggacggggaccacggtacggcccggtccg

SEQ ID NO: 433479 - DNA, 566 bp, Homo sapiens
  misc_feature: GZ8MTXP02FI6CD.4.57.F02.1.454.CMB.2.raw
  modified_base (230)..(230): a, c, t, g, unknown or other
  modified_base (365)..(365): a, c, t, g, unknown or other
  modified_base (462)..(462): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctggtgtgggaaccngcagtcggaaggtaaaagtgtacattggtacaggcagaagccaggccaggcccctgtggtggtcgtccgttatgatagccgaccggccctcgagggactcccgtgagcgtatcctctggctccaactctgggacncggccaccctgaccatcgagcgagggtcgaagggccggggatcggacggccgtacttacgttacgtgtcaggggtggagggtataggtaggtgggtnacgtcagtacagttaccgtcgttacggaacgtcgggacctaggttcctccggtcctacgtccgacgacccgaacggacccaacctccactcgtactacttcccg

SEQ ID NO: 433480 - DNA, 532 bp, Homo sapiens
  misc_feature: GZ8MTXP02FJVYR.4.57.F02.1.454.CMB.2.raw
  modified_base (411)..(411): a, c, t, g, unknown or other
  modified_base (420)..(420): a, c, t, g, unknown or other
  modified_base (437)..(437): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggacaggcagaagccaggccaggcccctgtggtggtcgtccgttatgatagcgaccggccctcgagggatcccctgagcgattcctctggctccaactctggggacacgggccacctgaccatcagcagggtcgaagccggggatgagccgatattacngtcaggtgngggataggtagtgggtnatcactctacgtacgtcgtacgacggtacggaacgtacggtccgtaccgtaccgtacgtacgaccgaccgaacgacacctcacgtcacacttccg

SEQ ID NO: 433481 - DNA, 548 bp, Homo sapiens
  misc_feature: GZ8MTXP02F3L0E.4.57.F02.1.454.CMB.2.raw
  modified_base (362)..(362): a, c, t, g, unknown or other
  modified_base (397)..(397): a, c, t, g, unknown or other
tcagagcactgtagcacgaccggtgctcgatttagctcgatatagttgggtttgggggcctaaggaagcagcactggtggtgcctcagccatgggcctggaccgttctcctcctcggcctcctctctcactgcacaggctctgtgacctcatatgtgctgactcagccaccctcagtgtcaggtcggccccagggcagacggccaggataacctgtgtgggaaccagcagtcggaaggtaaagtgtacattggtacaggcagaagccaggccaggcccctgtggtggtcgtccgttatgataggcgaccggccctcgagggactccctgacgcgattctctggcctccaactcgtgggaacncgggccacctgaccatcagcagggtcgagcgggangagcgactattactgtcaggtgtgggagtagtagtggtgatcgactccgtatacgtcgttacggaacgtcgggacctaacggtcgtccgtcctacgtcgacgacccgaacgacccaacccgtactcggtaccacgtcctctcccctacccc

SEQ ID NO: 433482 - DNA, 593 bp, Homo sapiens
  misc_feature: GZ8MTXP02I0HWP.4.57.F02.1.454.CMB.2.raw
  modified_base (211)..(211): a, c, t, g, unknown or other
  modified_base (373)..(373): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtaacctcatatgtgctgaatcagccaccctcagtgtcagtcggcccagggcagacgcaggatactgtgnggacagcagtcggaaggtaaagtgtacattggtacaggcagaagccaggccaggcccctggtggtggtcgtccgttatgatagccgaccggccctcgagggactcccgtgagcgtattctcgtggccctaccaactcgtgggaaccacggcccacctgaccntcagcgagggtcgaagcccggggatcggacggccgtaacttatacctgtcgagggtggtagggtaataggttaggtggtgatcgactccgattacgtcgttacggaacgttacgggaccgaaggttcccgtaccgtaccgttaccgcgaaccgaccccgaaacggaccccaaaccccgaacttcgtaccacttccgtacccttccccctaacccttcccc

SEQ ID NO: 433483 - DNA, 642 bp, Homo sapiens
  misc_feature: GZ8MTXP02IIZMO.4.57.F02.1.454.CMB.2.raw
  modified_base (330)..(330): a, c, t, g, unknown or other
  modified_base (368)..(368): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtaagtggccccagggcagacggccaggataacctggtgtgggaaccagcagtcggaaggtaaaagtgtacattggtacaggcagaagccaggccaggcccctgtggtggtcgtccgtatgatagccgaccggccctgagggactcccngagcgtattctccgtggctccaactcgtagggaaaccncggggcccacccctggaacccctagtccagtccgagggggtcgaaaggacccgggggatgggaacggcccggacttaagttaccgtgtccgaagggttggttaggggaattaggtaggttgggttggaacttcgacttaccgagttaaaccgttcgtttacgggaaaccgttcggggaacccgtaaagggttccctcccggtacccttacggtccaaccggccccaaagggccccaaaaccgttcctacgtcgtacccacttccgtttaccccg

SEQ ID NO: 433484 - DNA, 538 bp, Homo sapiens
  misc_feature: GZ8MTXP02IC14M.4.57.F02.1.454.CMB.2.raw
  modified_base (252)..(252): a, c, t, g, unknown or other
  modified_base (382)..(382): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctgggaatgggtgcagttatatggtttnatggaactaacaaattctatgcagactccgtgaaggcgattcacatctccagagacaatttcgagaacacattgaaatctaacagatacgaaactagtctagagagcgagacacggctgtactatattgngcgagagtagtgtcagtgtctttgacagtcgggcaggacctggtcaccgtctcctcacgccttccacgaacggtcccacgtccggtcccttccccgtggccctccctcgccgtccgacggacgccgaccgtcgtcggggcacgacggtccggcccg

SEQ ID NO: 433485 - DNA, 526 bp, Homo sapiens
  misc_feature: GZ8MTXP02FPEIH.4.57.F02.1.454.CMB.2.raw
  modified_base (363)..(363): a, c, t, g, unknown or other
  modified_base (445)..(445): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgaccggccctcgagggactccccgtgagcgattcctctggctccaactcgtgggaccncggccaccctgaccatcagcagggtcgaaggccggggatggaggccgatattactgtcgaggtgtgggataggtagtgggtnatcgatcgatcgtcttcggaactcgggacaggtcctccgtcctacgtcacgcccaaggcccaaacgtccactcgcacttcc

SEQ ID NO: 433486 - DNA, 736 bp, Homo sapiens
  misc_feature: GZ8MTXP02JMGNW.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacagttggtacaggcagaagccgaggccacggccctggtggtggtcgtccgttatgataggccgaccggccctcgacgggactcccgtagacgcgtattcccgtacgtcggcctaccgtaacgtccgttacggggacctacccgggacccctaaccccgtccgaacctacgtacgaacggccggtacgggggtaccggaaacggggccgggggaattacggggaacggtacccggtaacttaacgtttacgtacgggtacgtaaagggggttgggtaggggtaagttaaggggttggttagggtagaacgttacacgtacctaacgttaccggttaccggtttaacgggaaaccggtttacgggggaaacccgtaacgggttccccgtaccccggttacgttacccggtaccgaccggaacccccgtaaacgggtacccctaaacccgttacccgtaaccgtttcggtaacccgtacctttccccgg

SEQ ID NO: 433487 - DNA, 568 bp, Homo sapiens
  misc_feature: GZ8MTXP02GJ6NA.4.57.F02.1.454.CMB.2.raw
  modified_base (295)..(295): a, c, t, g, unknown or other
  modified_base (434)..(434): a, c, t, g, unknown or other
  modified_base (544)..(544): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggataacctgtgtgggaaccagcatcggaaggtaaaagtgtacagttggtacaggcagaagccaggccaggcccctgtggtgtcgtccgttangatagcgaccggccctcgagggactcccgtgacgcgtattctctggcctaccaactcgtagggaaaccaccgggcccaccctgaaccatcgaagcgaggggtacgaaacggccggggatggacggccgaactagttacngtacagggtgtgggataggtagtggtgatcaatccattacgtcgttacggaacgtcggggaactaacggtcctaccggtcctacgtcacgacccaacggacccaaacccntcgacactctccgtaccctacccc

SEQ ID NO: 433488 - DNA, 632 bp, Homo sapiens
  misc_feature: GZ8MTXP02G5EQR.4.57.F02.1.454.CMB.2.raw
  modified_base (255)..(255): a, c, t, g, unknown or other
  modified_base (353)..(353): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctgggaatggggtggctagttatatggtttnatggaactaacaaattctatgcagactccggtgaaggccgattcaaccatctccagagaacaatttcgaagaacactattgaatctaacagatgaacngtctagagacgccgagacacggctgtctattatgtgcgagagtaagtgtctagtcggttctttacgaccgtaggtcggggaccgtacggggtaaacccgtcggtccgaacccggttcctccgtaccacggtaccctttaccgaaacccgtaacgggcccctaacgttcccgggttcccctttcccccgtcggtcccgtcccccgttcgcccgttacccgacgggaacgcccgtaacccggttccggtcgggggaccaacccgtacggcccggtccccgg

SEQ ID NO: 433489 - DNA, 575 bp, Homo sapiens
  misc_feature: GZ8MTXP02JA2X8.4.57.F02.1.454.CMB.2.raw
  modified_base (228)..(228): a, c, t, g, unknown or other
  modified_base (368)..(368): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccngcatcggaggtaaagtgtacattggacaggcagaagccaggccacggcccctggtggtggtcgtccgttatgataggccgaccggccctgaggggactcccgtgagcgtattcctcgtggctaccaactcgtagggaccncggcccacctcgaccatcagcgaggggtcgaaggccggggatcggaggcccgatattacgtgcagggtgtagggataggtaggtgggtagatcgatcccgtaagttccgtcgttacggaaacgttcggggaacctaaggtccgtaccggtcctaccgtaccacgacccgaaacggcccaaaccttccacgttcgtacctactttccg

SEQ ID NO: 433490 - DNA, 546 bp, Homo sapiens
  misc_feature: GZ8MTXP02J0B0C.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtcgttatgatagcgaccggccctcgagggatcccgtgagcgattccctctggctccaactcgtagggaccacgggccaccctgacccatcagcgaggggtcgaaggccggggatggacggccgactattcgtgtcgagggtggtgggataggtagtgggtgatcatccagtacgtcgtacggaactggggaccagggtcctaccggtcctacgtaccacgacccgaacggcccaacctccactcgtccacttcccg

SEQ ID NO: 433491 - DNA, 590 bp, Homo sapiens
  misc_feature: GZ8MTXP02FRRDR.4.57.F02.1.454.CMB.2.raw
  modified_base (225)..(225): a, c, t, g, unknown or other
  modified_base (367)..(367): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtggaaccngcatcggaaggtaaaagtgtacattggacaggcagaagccaggccacggcccctgtggtggtcgtccgttatgataggcgaccggccctcgagggactcccgtgagcgtattcctctggctaccaacgtcgtacggggaccnccggacccacccgtcgacccatcgagcgagggtacgaacggccggggatgggacggccgaattacgttacgtagtcgagggtggtagggataggtagtgggtgaactcagtcctaattaccgtcgttacgggaacgtacgggaacctaagggtcctccggtaccttaccgtacgaccgacccgaaaggccccaaaacgttcccacttacgtaccacctttccg

SEQ ID NO: 433492 - DNA, 646 bp, Homo sapiens
  misc_feature: GZ8MTXP02J2869.4.57.F02.1.454.CMB.2.raw
  modified_base (178)..(178): a, c, t, g, unknown or other
  modified_base (232)..(232): a, c, t, g, unknown or other
  modified_base (334)..(334): a, c, t, g, unknown or other
  modified_base (346)..(346): a, c, t, g, unknown or other
  modified_base (373)..(373): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctnagtgtcagtcggccccagggcaggacggccaggataaccgtgtgtagggaaccngcagtcggaaggtaaaagtgtacagttggacaggcagaagccaggccaggcccctgtggtggtcgtccgttatgatagcgaccggccctgagggactcccgngagcgattcccncgtggcctaccaactcgtacgggaccnccgggaccccacccgtgaacccatcacggcgaacggggtcgaaacgggcccgggggatcggacggggaccctaattacgttaccgtggtacgaggggttggtgggagttaggtaggtggggtatatacgtaactcccgaagtttaccggttaccgttacggggaacttcgggggaaccctaacgggtcccttacccggtacccgttaccgtaccgaaccggacccccgaaaggtaccccaaaccgtccctaacgtcgtaccctacctttcccg

SEQ ID NO: 433493 - DNA, 547 bp, Homo sapiens
  misc_feature: GZ8MTXP02JB2ZE.4.57.F02.1.454.CMB.2.raw
  modified_base (209)..(209): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccnccaggctccaggcaaggggctggaatgggtggcagttatatggtttgatggaactaacaaattctatgcagactccgtgaaggccgattcaccatctccagagacaatttcgaagaacacattgaatctaacagatgaaacagtctgaagagccgagacacggctgtctattatgtgcgagagtaagtgtcagtgttctttgacaggtgggccgagggaccctggtcaccgtctcctcacgcttaccaccgacggcccaactccggtccttccccctcggcccgtcccgtcgcctcccgacgaacgcctaccgtcggtcggggcaccgacgccccggg

SEQ ID NO: 433494 - DNA, 632 bp, Homo sapiens
  misc_feature: GZ8MTXP02IVHL4.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacgcaggataacctgtgtggaacagcagtcggagtaaagtgtacattggacaggcagacgcaggccacggcccctggtggtggtcgtccgttatgatagccgaccggccctcgagggactcccgtgacgcgtattctctcggcctaccaacgtcgtagggaaccacggcccacccgtcgaccactcgacgcgacggggacgaacggcccggggaatcgggacggacccgtaactacgtactcggtacgagggttggtagggaagttaggttaggtgggtagtacgtctaactccgtaagttaccggtacgttaccggggaaacgtcggggaaacctaaacggggttcctacccggtacccgttaacgtccgaaccgacccgaacggaccccaaacccgtactacggtaccaaccgttccgtaccctcccctaaccccc

SEQ ID NO: 433495 - DNA, 612 bp, Homo sapiens
  misc_feature: GZ8MTXP02I8C2T.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggaggtcggggggaggcgtggtccagccgtggggggtccctgagactctcctgtgcagcgtctggattcgccttcagtgcctatggcatgcacgtcgggtccgccaggcctcccgaggcgaaggggctgggaagtggggtgctagtttatagttggtttagataggaactaaacaaatttctaatggcaagtacctccggtagggaaacggggtccgtattacccaacctaactcctaccgaagacgtaactaacgtttacgaacgaaactaactattagaacttactaacgagtaacgtagaacctaaggttcgaggaagacggaccggaaggaaccgacggtctgttacttaattcgttacgtgagaaggtacgtaagttaggtctagtcggtttactttacgg

SEQ ID NO: 433496 - DNA, 509 bp, Homo sapiens
  misc_feature: GZ8MTXP02IY8ND.4.57.F02.1.454.CMB.2.raw
  modified_base (227)..(227): a, c, t, g, unknown or other
  modified_base (299)..(299): a, c, t, g, unknown or other
  modified_base (361)..(361): a, c, t, g, unknown or other
  modified_base (413)..(413): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggaggtaaaagtgtacattggtacaggcagaagccaggccaggcccctggtggtggtcgtccgttangatagcgaccggccctcgagggactcccctgagcgtattcctctggctccaactctgggacncggccaccgtgaccatcagcagggtcaagccggggatgaggccgatattacngtcgaggtgtagggatagtagtggtcgatcatcatcgtctcgaactcgggacaggtctacgtctacgcacgccaaggccaactccatcgacacttc

SEQ ID NO: 433497 - DNA, 555 bp, Homo sapiens
  misc_feature: GZ8MTXP02FSYL1.4.57.F02.1.454.CMB.2.raw
  modified_base (360)..(360): a, c, t, g, unknown or other
  modified_base (427)..(427): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaggtaaaagtgtacattggtacaggcagaagccaggccaggccccctgtggtggtcgtccgttatgatagcgacccggcctcgagggactccctgagcgtattcctctgctccaactcgtagggacncggccaccctgaccatcagcagggtacgaagccggggatgaggcccgaactattactgtcagggtgngggatagtaggtggtgatcgatccaatacgtcgttacggaaacgtcgggaccaaagggtcctacccggtacctacggtccacggacccaaacgggtcccaaaactcccaacgtcgtacctacttcccg

SEQ ID NO: 433498 - DNA, 634 bp, Homo sapiens
  misc_feature: GZ8MTXP02IYBSE.4.57.F02.1.454.CMB.2.raw
  modified_base (221)..(221): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacgcaggatactgtgtggaccngcagtcggagtaaagtgtacattggtacaggcagaagccgaggccaggcccctgtggtggtcgtccgttatgatagcgaccggccctcgagggatcccgtgagcgattccctctcggctaccactcgtagggaccaccgggccacccgtcgaccatcagcgagggtacgaaggccgggggatggacggccgaacttagttaaccgtgtcgtagggtggtaggggagtttagggtaggtgggtagtactacgtacgtaccctaagttaccggttcgttaaccggggaaacgtcggggtaaacccgtaaacggggttccgttaccccggtaccgttaaccgtaccgaacccggaccccgaaaccgggtaccccaaaacccgttcccaccgttaccgtacctaacccgtttccccg

SEQ ID NO: 433499 - DNA, 525 bp, Homo sapiens
  misc_feature: GZ8MTXP02JT8L2.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcaggggatcccgtgacgcgattcctctggcctccaactcgtagggacacgggccaccctgaccatcagcagggtcgaagccggggatggagtccgatatactgtcaggtgtgggatagtagtgggtgatcatccagtacgtcgttcggaacgtgggaccaggtctcccggtcttaccgcacgcccaaggccaaactccactcgtacactcc

SEQ ID NO: 433500 - DNA, 557 bp, Homo sapiens
  misc_feature: GZ8MTXP02FZ1KN.4.57.F02.1.454.CMB.2.raw
  modified_base (295)..(295): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagagccaggccaggccctgtggtggtcgtccgttangatagccgaccggccctcgagggactcccgtgacgcgattctcgtcggcctccaacgtcgtagggaaccaccgggcccacccgtcgaccatcagcgaggggtcgaaacggccggggagtcggacggccgactagttacgtgtcgaggtggtagggataggtagtggtgatcatccatacgtcgtacggaacgtgggacaaggtcctaccgctacgtcacgaccacgacccaacccgactcgtcacctctaccgtccctaccc

SEQ ID NO: 433501 - DNA, 538 bp, Homo sapiens
  misc_feature: GZ8MTXP02I6T7C.4.57.F02.1.454.CMB.2.raw
  modified_base (366)..(366): a, c, t, g, unknown or other
  modified_base (421)..(421): a, c, t, g, unknown or other
  modified_base (448)..(448): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaaagtgtacattggacaggcagaagccaggccaggcccctgtggtggtcgtcgtatgatagcgaccggccctcgagggactcccgtgagcgtattccctcgtggcctaccaactcgtagggaccnccggcccaccctgaccatcagcgagggtcgaaggccgggatgaggccgatatacngtcgaggtgtagggataggtagtggtnacgtcatcagtacgtcttacggaacttcgggacctaaggtcctccgtactacgtcacgacccgaaggcccaacgtccactcgtcactccg

SEQ ID NO: 433502 - DNA, 561 bp, Homo sapiens
  misc_feature: GZ8MTXP02HJRH0.4.57.F02.1.454.CMB.2.raw
  modified_base (442)..(442): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggcccaggcagacgcaggatactgtgtggaacagcagtcggaaggtaaagtgtacagttggacaggcagaagccaggccaggcccctggtggtggtcgtcgtatgatagcgaccggcctgaggactcccgtgacgcgtattctcgtcggcctaccaactcgtaggaaccacggccaccctgaccatcagcgagggtacgaaggccgggatggacggccgaattacgtacgtgtcgagggtgtagggtataggtgtggtnagtcacgtccagtacgtcgtacggaacgtcgggactaacggtcctccgtactacgtcacgtacccgaacggaccccaacccgtacgtcgtacctacgttcctaccgttaccccctaccc

SEQ ID NO: 433503 - DNA, 620 bp, Homo sapiens
  misc_feature: GZ8MTXP02GFAGC.4.57.F02.1.454.CMB.2.raw
  modified_base (251)..(251): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttnatggaactaacaaattctatgcagactcgtgaaggcgattcaccatctccagagacaatttcgagaacacattgaatctacagatacgaaacagtctagagagcgaggacacggctgtactatttatgtgacgagagtaagtggtctaagtcggttccttttgacccgtaggtcgggggaccaacggggaaacccgtcgggtaccacccgttcgtccctccgacgtccctttacccgaaccgtaaaccggggacccctacgttcccggttccctttcccccggtggtccccgtccccgttcgacccgttacccgtacgggacgcccgtacccgtcggtcgggggaccaccggacgggtcccggccccgg

SEQ ID NO: 433504 - DNA, 521 bp, Homo sapiens
  misc_feature: GZ8MTXP02HL4ZE.4.57.F02.1.454.CMB.2.raw
  modified_base (359)..(359): a, c, t, g, unknown or other
  modified_base (415)..(415): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggcctcgagggatcccgtgagcggattccgtctggctccaactcgtgggacncggccacccgtgaccatcagcagggtcgaaggccggggatgaggccgactattacngtcaggtgtgggattagtagtggtgatcatccatacgtcttcggaactcgggaccaaggtcctccgtcctacgtcacgcccaaggccaaactccatcgtcactccg

SEQ ID NO: 433505 - DNA, 561 bp, Homo sapiens
  misc_feature: GZ8MTXP02H4UT2.4.57.F02.1.454.CMB.2.raw
  modified_base (432)..(432): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccagcagtcggaaggtaaaagtgtacattggtacaggcagaagccaggccaggcccctggtggtggtcgtcgtatgatgcgaccggcctgacgggatcccgtgacgcgtattcgtctcggcctccaactcgtagggaaccaccggccaccctgacccatcagcaggggtacgaaggccggggatggacggccgtaactactacgtgtacgngggtgtagggataggtagtggtagatcatcagttacgcgttacggaagtcgggaactaacggtcttaccgtcctacgtcacgacccaacggacccaacccgactcgtcactccgttacgtcccctaccc

SEQ ID NO: 433506 - DNA, 553 bp, Homo sapiens
  misc_feature: GZ8MTXP02ICJNC.4.57.F02.1.454.CMB.2.raw
  modified_base (330)..(330): a, c, t, g, unknown or other
  modified_base (417)..(417): a, c, t, g, unknown or other
  modified_base (437)..(437): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtcgttatgatagcgaccggccctcagggatccctgagcgattcnctcggctccaactctgggaacacggccaaccctgaccatcagcagggtcgaaagccggggatgaggccgactattactgtcaggtgngggattagtaggttgggtanatcatacgagttacgtcgttacggaacgtacgggaaccgtaacggtcctccgtacctacgtacacgacccgaacgacccaaacccgtcgtacgtaccactcctacgttaccccacc

SEQ ID NO: 433507 - DNA, 630 bp, Homo sapiens
  misc_feature: GZ8MTXP02ITEGK.4.57.F02.1.454.CMB.2.raw
  modified_base (586)..(586): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagccgtgggggtccctgagactctcctgtgcagcgtctggattcgccttcagtgcctatggcatgcacgtgggtcccgccaggcctccgaggcgaagggggctgggaagtggggtggctagttatagtggtttgagtggaaactaaacaaattctatgcagactccgtagaacgggccgattcaccatctaccagagtaactaatttacgaagaaacactatttagaaattctaacagaatacgaaactagtctaggagacgaccgaggacacggcttgtactattgttgcgagagtagtaggtgtctattcggttcttagacgaggtcgggaccgacggtacccgtggtaccaccgtactcctcgacgtccttacccgacgaaccgggtccctaagttcccggttcccgtttcccccgtacgggtcccgccccgttcgaccttaccgagggacccnccggtaccggtcgggtaccgggacaccggccggtcccggtccgg

SEQ ID NO: 433508 - DNA, 539 bp, Homo sapiens
  misc_feature: GZ8MTXP02FTDBB.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggaggcgtggtccagcctggggggtccctgagactctcctgtgcagcgtctggattcgccttcagtgcctatggcatgcacgtgggtcccgccaggcctcccagggcgaagggggctgggaagtggggtggctagttatagtgggtttgataggaactaacaaattcatgcagactcggtgaacgggccgattccacatctaccagagactaattcgagaacacattagaatctacagatacgaacagtctagagagccgaggacgacggctgtcttattattgtgcgaagtagtaaggtggtactagttcggttcttttacgg

SEQ ID NO: 433509 - DNA, 607 bp, Homo sapiens
  misc_feature: GZ8MTXP02IB80G.4.57.F02.1.454.CMB.2.raw
  modified_base (313)..(313): a, c, t, g, unknown or other
  modified_base (390)..(390): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcaggtcggccccgagggcaggacggccaggataacctgtgtacgggaaccagcagtacggaaggtaaaagtgtaactagttggtacaggcaagaagccaggccacggcccctggtggtggtcgtccgttangatacggcgacccggccctcgagggactcccgtagagcgtattccctacgtcggcctaccaacgtcgtacgggaccnccggcccacccgtgaccatcacggcgtaggggaccgaaagggccgggggatgggacggccgtaactattaccgtgcgtagggtggtgggagtaggtaggtgggtagatcgatcgagttaccgtcgttacggaacggttacgggaaccgtaggtccttacccggtacctaccgtacacggtaacccgaaggacccaactcccaagtctcactttcccg

SEQ ID NO: 433510 - DNA, 541 bp, Homo sapiens
  misc_feature: GZ8MTXP02JV7VZ.4.57.F02.1.454.CMB.2.raw
  modified_base (335)..(335): a, c, t, g, unknown or other
  modified_base (357)..(357): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccattcaccatctccagagacaatttcgaagaacacattgaaatctaanagatgaacagtctgagagccgnggacacggctgtctatttatgtgcgagagtaagtggtcatgtctttagacctagtgggcgagggaccgtagtcaccgtctcctcacgcttaccaccgaacggccacgtcgttcccttccccgtcgccgtcccgtcgccgtccgacgacgccaccgtcgtcgggggcaccgacggccggtcccgg

SEQ ID NO: 433511 - DNA, 571 bp, Homo sapiens
  misc_feature: GZ8MTXP02H2403.4.57.F02.1.454.CMB.2.raw
  modified_base (174)..(174): a, c, t, g, unknown or other
  modified_base (221)..(221): a, c, t, g, unknown or other
  modified_base (569)..(569): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctnagtgtcagtggcccagggcagacggccaggataactgtgtggaaccngcagtcggaaggtaaaagtgtacagttggtaacagtcagaagccaggccaggcccctgtggtggtcgtcgtatgatagcgaccggcctgaggactccctgagcgtattctcgtcggctaccgaactcgtaggaaccacggcccaaccctgacccataccagacagggtaccgaaagggcccgggggatggacgggacccgtaagttaacgttaccgtggtacggggttgtagggaataggtaggtggtgatcgatcgatacgtctacggaactgggaaccaaggactccgtcgtactacggcacgacccaaggcccaaacccgtcacgtcaccttctccgttcccccncc

SEQ ID NO: 433512 - DNA, 536 bp, Homo sapiens
  misc_feature: GZ8MTXP02FMSZ1.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtggaaccagcatcggaaggtaaaagtgtacattggtacaggcagagccaggccaggcccctgtggtggtcgtccgtatgatagcgacccggccctcgagggatccctgagcgtattcctctggctccaactctggggaccaccgggcccaccctgaccatcagcaggggtcgaaaggccgggggatgaggccgaactattcagtcagggtgtgggatagtagtggtgatcatccatacgtcgttacgggaactcgggacctaaggtcctccgtacctacgtcacggcccaaggcccaacctccactcgtccactcccg

SEQ ID NO: 433513 - DNA, 564 bp, Homo sapiens
  misc_feature: GZ8MTXP02JGNOW.4.57.F02.1.454.CMB.2.raw
  modified_base (220)..(220): a, c, t, g, unknown or other
  modified_base (287)..(287): a, c, t, g, unknown or other
  modified_base (302)..(302): a, c, t, g, unknown or other
  modified_base (539)..(539): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacggcaggatacctgtgtgggaaccngcagtcggaaggtaaagtgtacagttggtacaggcagagcaggccaggccctgtggtgtcgtcgtangatagcgaccggccncgagggactcccgtgacgcgtacttctcgtcggcctaccgaactcgtacgggaacaccgggcccaccctgaccatccgagcgagggtacgaaggccggggatcggaggccgaacgtattacgtgtacgagggtggtagggattagggtaggtggtaggatacatcccagttaccgtcttacgggaacgtgggaacctaggtcctcctccgtacgtcacgaccacggacccaacccgntcgtccactctccgtccccgtaccc

SEQ ID NO: 433514 - DNA, 833 bp, Homo sapiens
  misc_feature: GZ8MTXP02GHE1U.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggccaggataacctgtgtgggaaccagcagtcggaaggtaaagtgtacagttggtacaggcagagcaggccaggccctgtggtggtcgtccgttatgatagcggaccggccctcgacggggactccccgtaggacggtccgtatttccgtcgtcgggtcccttacccgaaaccgttccggtaacggggaaaccaccgggcccctaaccccgtacggaccccaagttccgaacgggccggtaaacgggggtaccgggaaacgggggacccggggggtaattaacgggggaacgggtaccccggtaaaacgtttaacgtttaacccggttcgggttaccggtaaagggggtttcggggttaaacgggggtaaagtttaaagggggttaacggggtttgggggtacgttaaaggttacctaaacgttcccgtaaagtttaacccgggtttacgtttaaccggggtaaaaccggttcgggggtaaacccctaaaacgggggtttccccttacccgggttaccccgttaaacccggtaccgaaaccggacccccgtaaaacggggaccccctaaaaacccccgtccgttacggtacccctaaccgtttcccgttacccggtttaccccccttaaccccccg

SEQ ID NO: 433515 - DNA, 610 bp, Homo sapiens
  misc_feature: GZ8MTXP02HPGWC.4.57.F02.1.454.CMB.2.raw
  modified_base (203)..(203): a, c, t, g, unknown or other
  modified_base (279)..(279): a, c, t, g, unknown or other
  modified_base (311)..(311): a, c, t, g, unknown or other
  modified_base (316)..(316): a, c, t, g, unknown or other
  modified_base (328)..(328): a, c, t, g, unknown or other
  modified_base (338)..(338): a, c, t, g, unknown or other
tcagagcactgtagcacgaccggtgctcgattagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccgaggaaagggctaggaatgggtgcagttatatggttgatggaaactaacaaattcatgcagactcgngaaggccatcacatctcagagactaattcganaacanattgaatctaangatagaaccngtctgaagagaccgagacacggcttagtacttaatttagtggtgacgagaagtaagtggtactagttggttcctttgaaccgtagggtaccgggaccgtaaggggtaacccctgggtaccgtaaccggttctccgtacgcgtaccttacccgaaaccgtacgggaccctacgtccggttccccttcccccgtggcccgtcccgttcggcctaccggaacgtaccgcctaacccggtcggtcgggggacccagtccggccggtcccgttcggg

SEQ ID NO: 433516 - DNA, 665 bp, Homo sapiens
  misc_feature: GZ8MTXP02HX839.4.57.F02.1.454.CMB.2.raw
  modified_base (250)..(250): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcagtcggcccagggcagacggcaggactaactgtgtggaaccagcagtcggaaggtaaagtgtacattgganaggcagaagcaggccaggccctggtggtggtcgtcgtatgatacgccgaccggcctagacgggactcccgtgacgcgtattctcgtcggcctacccgaactcgtacgggaaccaccgggcccaccgtacgaccaccacgtacgacgacggtacggggacgaacgggggacggtaggacggaccggtaaccgttaacgttaacgttacggtacggtacggtagggttagggtacgggtaagttagggttagggtacggtagtacgtacgtacgtaccgtaagttaccggttacggtaaccggtacggtaccggtaaccgtacggttaccgttacccgtacgtacgtaccgtacccgaaccgacccgaacccaacccgtacgtaccgtacctacccgttccgttccccgtacccccg

SEQ ID NO: 433517 - DNA, 627 bp, Homo sapiens
  misc_feature: GZ8MTXP02G31S1.4.57.F02.1.454.CMB.2.raw
  modified_base (296)..(296): a, c, t, g, unknown or other
  modified_base (466)..(466): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaagtgtacagttggtacaggcagaagccaggccaggccctggtggtggtcgtcgtangatagcgaccgcctgagggactcccgtgacgcgattctctcggcctaccaacgtcgtacggggaaccacgggcccacccgtgaccatcgagcgacggggtacgaaggccggggatcggacggccgaactagttacgtgtcgagggtggtagggaataggtaggtgggtanagttacaacgtcccaagttaccggtccgttacgggaaacgtcggggaaccctaacgggtcccttacccggtaccttaaccgtacgaccggaccccgaaacggacccccaaaaccccgtctccggtacctaccgttcccttacccgttacccctaacccccg

SEQ ID NO: 433518 - DNA, 522 bp, Homo sapiens
  misc_feature: GZ8MTXP02I10CR.4.57.F02.1.454.CMB.2.raw
  modified_base (273)..(273): a, c, t, g, unknown or other
  modified_base (288)..(288): a, c, t, g, unknown or other
  modified_base (305)..(305): a, c, t, g, unknown or other
  modified_base (352)..(352): a, c, t, g, unknown or other
  modified_base (408)..(408): a, c, t, g, unknown or other
  modified_base (431)..(431): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagagcagccaggccctgnggtggtcgtcgttangatagcgaccggccctnagggactccctgacgcgattctctcggctccaactcgtagggaaccncggcccaccctgaccatcagcgagggcgaaggccgggatggacggccgatactacngtcgaggtgtgggatagtagtgngatcatcatcgtcgtgactggaccaaggtctccgtctacgtcacgcccgaacggcccaacccgctacgtccactccgtcgtaccctacccc

SEQ ID NO: 433519 - DNA, 581 bp, Homo sapiens
  misc_feature: GZ8MTXP02GT70Y.4.57.F02.1.454.CMB.2.raw
  modified_base (277)..(277): a, c, t, g, unknown or other
  modified_base (282)..(282): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaaagtgtacattggtacaggcagaagccaggccaggcccngtggngtcgtcgtatgatagcgaccgcctcgaggctcccgtgacgcgtattctcgtcggtcctaccaactcgtacggggaaccaccgggcccacctcgacccatcagcgaggggtacgaacggccggggatcggaggcccgagtattacgtgtcgaggtggtaggagtaggtaggtggtagtatacgataccgagttacgtcgttacggaacgtcggggactaaacgggtcctaccggtaccctacgtcacgacccgaacggtacccaaccccgctacgtccacctcgtccgttaccctacccc

SEQ ID NO: 433520 - DNA, 571 bp, Homo sapiens
  misc_feature: GZ8MTXP02HXK8G.4.57.F02.1.454.CMB.2.raw
  modified_base (333)..(333): a, c, t, g, unknown or other
tcagagcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcactgggtccgccaggcctccgagggcaagggggctggaatggggtggctagttatagttggtttgataggaactaacaaattctatgcagactcgtagaagggccatcaccatctccagagactaattcgagaacanattagaatctaacagatacgaacagtctagagacgcgaggacaggctgtactattatgtgacgagagtagtgtctagtcgttctttgaccgtaggtcgggaccgtacgggtaaccgtggtccaccgtcgtcctcgacgtcttacccgacgaacgggccacgttccgtcccttccccgtcggccgcctacgcctccgacggcgccgaccgtcggtcggggcaccggacgccggtcccgg

SEQ ID NO: 433521 - DNA, 512 bp, Homo sapiens
  misc_feature: GZ8MTXP02F0TB7.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatgggtgcagttatatggtttgatggaactaacaaattctatgcagactccgtgaaggccgattcacatctccagagacaatttcgagaacacattgaatctacagatgaacagtctgagagccgaggacacggctgtctattatgtgcgagagtaagtggtcatgtctttgacagtgggcgaggaacctggtcaccgtctctcagcttccacacggccagtcgtctcccgtgccgccctcgcctccgagacgccgaccgtcgtcgggggcacgcgccggcccgg

SEQ ID NO: 433522 - DNA, 642 bp, Homo sapiens
  misc_feature: GZ8MTXP02JGKAL.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtagggaaccagcagtcggaaggtaaaagtgtacagttggtacaggcagaagccgaggccacggcccctggtcggtggtcgttccgttacgtgtagtagacggacccggccgtcgacggacgtcctggacgacgtacttactctcggtcctacctaacctacgtacgggtaaccgaccggcccgaccctacggacccactacgacgacgacgggtaacggaacggaccggggagtggacggaccgactactaacgtcgtgacggtggtaggaggtagttaggtggtcggtagtacctacgtacctacgttacggtccgttaccggtaaacgtacgggtaaccgtaacggtaccgtcccgtacccgttaacgccgtacgaccccgaacgacccgaacccacgtactcgactcctacgtacccttacccc

SEQ ID NO: 433523 - DNA, 664 bp, Homo sapiens
  misc_feature: GZ8MTXP02IP43A.4.57.F02.1.454.CMB.2.raw
  modified_base (219)..(219): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggcccaggcagacggcaggataacctgtgtggaaccngcatcggagtaaagtgtacattggacagtcagaagccaggccaggcccctgtggtggtcgtcgtatgatagcgaccggcctcgagggactccctgagcgtattcgtctcggctaccaactcgtgggaaccacgggcccaccctgacccatccagcagggtccgaaaggcccggggatggaggacccgattacttacgtgtacgaggtggtagggattaggtaaggttggtagtacgtcaacgtcccgtaagttaaccggttcgtttaccgggaaacgttcgggggaaaaccctaaaacgggggttccccttacccgggttaccccttaaacgggttacccgaaccggtaacccccctaaaacggggacccccctaaaaaaccccctccggttacgttacccccgaacctttcccgttaaccggtttcccccccttaaaccccccg

SEQ ID NO: 433524 - DNA, 643 bp, Homo sapiens
  misc_feature: GZ8MTXP02G484K.4.57.F02.1.454.CMB.2.raw
  modified_base (287)..(287): a, c, t, g, unknown or other
  modified_base (407)..(407): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacgcaggatacctgtgtggacagcagtcggaaggtaaagtgtacagttggacaggcagaagccaggccaggcccctgtggtgtcgtcgttangatagcgaccgcctcgaggactcccgtgacgcgtattcgtctcggcctaccaactcgtacggggaaccacgggcccacccgtgacccatcgacgcgacggggtacgaaggcccgggggancgggacggcccgtacttacgttacgtggtcgagggtggtagggattagggtaggttgggtagtacgttacacgttcccgaagttaccggttacgtttaccgggaaacgtcggggaaccgtaacgggttccctacccggttaccctaaccggtaccgaaccgaccccgaaacggaccccctaaaaccccgacgtaccggttaccacctttcccgttaccgttaccccctaacccccg

SEQ ID NO: 433525 - DNA, 554 bp, Homo sapiens
  misc_feature: GZ8MTXP02IIA3Q.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtgcagttatatggtttgatggaactaaacaaattctatgcagactcgtgaaggccatcaccatctccagagacaatttcgaagaacactattgaaatctaacagatgaacagtctgagagccgaggacaacggctgtctattattgtgcgagagtaagtgtcatggttctttgacagtgggcacggaaaccgtgtccaccgtctcctcgacgcttaccaccaaacgggccctaactccggttccttcccccgtggccgtcccctcgccgtaccgacggacgcctaaccctcggtcgggggaccacggacgcccggtcccgg

SEQ ID NO: 433526 - DNA, 700 bp, Homo sapiens
  misc_feature: GZ8MTXP02IEE64.4.57.F02.1.454.CMB.2.raw
  modified_base (228)..(228): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcatcggaaggtaaaagtgtacattggtacaggcagaagccaggccaggcccctgtggtggtcgtccgttatgatagcgaccggccctcgagggactccccgtgacgtcgattccctcgtcgggtcctccgtaaacttccgtacggggaaccacccggggcccaaccccgtgaccccaacgtccgaacgccgtaagggggtccggaaagggcccgggggaatcgggaacgggcccgtaaacgttaagttaacccgtggtaccgaggggttggtaggggaagtttagggtaggttgggtagagttacgaactccgaacgttaccggtcgtttacggggaaacttcgggggtaaaaccctaaacggggttccttaccccgggtacccttacccggtacccctaacccccgaaacggggaaccccctaaaccgttacccaaccgttcggtaccctaacctttccgtttacccccg

SEQ ID NO: 433527 - DNA, 598 bp, Homo sapiens
  misc_feature: GZ8MTXP02JDLZM.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcaggtcggccccagggcaggacggccaggataacctgtgtgggaaccagcagtcggaaggtaaaagtgtacagttggtacaggcaagagccaggccaggcccctgtggtggtcgtccgttatgatagcgaccggccctcgagggactcccgtgagcgtattcctcgtcggcctccgaactcgtacgggaccacgggccacccgtgaccacgtcagcgagggtacgaagggccggggatggacggccgacttagtacgtagtcaggggtgtgggagttagtaggtaggtagactcgactccgaagttaccggtacgttacgggaacgttacgggaaccctaagggtcccgtacccgttaccgtaccgtaccacgacccgaacggacccaaacgtcccgaatcggtacacctttcccg

SEQ ID NO: 433528 - DNA, 589 bp, Homo sapiens
  misc_feature: GZ8MTXP02I9YQA.4.57.F02.1.454.CMB.2.raw
  modified_base (360)..(360): a, c, t, g, unknown or other
  modified_base (365)..(365): a, c, t, g, unknown or other
  modified_base (429)..(429): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcaaccctcagtgtcagtggccccagggcagacggccaggataacctgtgtgggaaccagcatcggaaggtaaagtgtacattggtacaggcagaagccaggccaggcccctgtggtggtcgtccgttatgatagcgaccggcctcgagggactccccgtgacggcggtacttccgctaggctccaactcgnggacncggccaccctgaccagtcagcgagggtacgaacgccggggaatcgggagcccgactagttacgngtcgtaggtggtaggagtaggtaggtggtagactcgacgtactacgtacgttacgttacggaacgttacgggaaccgtacggttcccgtacccggtacgtaccgtaccgaccggacccgtaacgaccctaaaccgtcccgtacgtaccgtacctactccg

SEQ ID NO: 433529 - DNA, 520 bp, Homo sapiens
  misc_feature: GZ8MTXP02I2XM6.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacatggtacaggcagaagccaggccaggcccctgtggtggtcgtcgttatgatagcgaccggccctcgagggactcccctgagcgattcctctaggctccaactctggggacaccgggccacccgtgacccatcagcagggtcgaacgcggggatgaggccgactatactgtcaggtgtgggatagtagtggtgatcatccatacgtcttcggaactgggacctaaggtctccgtcctacgtcacgaccaacggccaaactccactcgctactcc

SEQ ID NO: 433530 - DNA, 664 bp, Homo sapiens
  misc_feature: GZ8MTXP02HFR4Q.4.57.F02.1.454.CMB.2.raw
  modified_base (219)..(219): a, c, t, g, unknown or other
  modified_base (321)..(321): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtcggcccaggcagacggcaggataactgtgtgggaaccngcagtacggaaggtaaaagtgtacagttggacaggcagaacgccaggccacggcccctgtggtgtcgtcgtatgagtacgcgaccgcctgagggactcccgngacgcgtattctcgtcggcctaccaacgtcgtacgggaaccacgggcccacccgtcgaacccatacgagacgtaggggaccgaaacggggcccggggaagtcgggaacgggacccgaacgttacgttaacgtcggtaccgtagggttggtagggaagttaggtaggtgggtagtaacgtacactaccgaacgttacggtccgttacggaacgtacgggaaccgtaacggtcccgttaccgtaccttaacggtacccaccgaccccgaaccgggaccccctaaaccccgacgttacccggttacccaaccgtttccctacccggtttacccccctaaccccccg

SEQ ID NO: 433531 - DNA, 659 bp, Homo sapiens
  misc_feature: GZ8MTXP02IF3XA.4.57.F02.1.454.CMB.2.raw
  modified_base (384)..(384): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcgggggggaggcgtggtccagccgtggggggtccctgagactctcctgtgcagcgtctggattcgccttcagtgcctatggcatgcacgtggggtccgccaggctccaggcgaagggggctgggaatggggtgcagttatagttggtttgatggaaactaacaattcatgcagactcgtgaacggcgatcacatctcagagaacatttcgaagaacactatgaaattctaaacagatagaactagtctagagacgcggagacgacggtntgtctattatgtgacgagagtagtgtactagtcgttctttgaccgtaggtcggggacccgtaacgggtacccgttggtacccgtacccggttccttcccgtactacggtccctttaccccgaacccggttaaacgggccccgtaacgtcccgggtttccccttccccccggtcgggtccccgtccccgttcgacccgttacccgaacggggaacccgtcccgtaaccccggttccggtaccgggggacccgtaccgggtaacgggtcccccgggg

SEQ ID NO: 433532 - DNA, 560 bp, Homo sapiens
  misc_feature: GZ8MTXP02IVVSZ.4.57.F02.1.454.CMB.2.raw
  modified_base (360)..(360): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtacattggtacaggcagaagccaggccaggcccctgtggtggtcgtcgttatgatagcgaccggcctgagggactccctgagcgattctctcggcctaccaactcgtgggaaccncggccaccctgacccatcagcgagggtcgaaggccgggatggaggcccgatattactgtcaggtgtgggattaggtagtgtgatcatccatacgtcgttacggaacgtgggaaccctaaggtccttaccggtaccctacgtcacgacccgaaacggccccaaacccgcttacgtaccacttccgtcgtttccccgtcccc

SEQ ID NO: 433533 - DNA, 755 bp, Homo sapiens
  misc_feature: GZ8MTXP02H473R.4.57.F02.1.454.CMB.2.raw
  modified_base (220)..(220): a, c, t, g, unknown or other
  modified_base (237)..(237): a, c, t, g, unknown or other
  modified_base (257)..(257): a, c, t, g, unknown or other
  modified_base (291)..(291): a, c, t, g, unknown or other
tcagagcactgtagcacgaccggtgctcgatttagctcgatatagttgggtttgagggcctaaggaagcagcactggtggtgcctcagccatggcctggaccgttctcctcctcggcctcctctctcactgcacaggctctgtgacctcatatgtgctgactcagccaccctcagtgtcagtgccccagggcagacggccaggactacgtgtggacgacngcagacggaagtaagtnactagttagacgagcagacncgacgcgacgccgtggtggtcgtcgtacgttagngagtacgccggacccgtccctacggacgggtacctccgtaggacgtaccgtactttccgtccggtcggtacccccttaacccgtaaccgttcgggtaaaccgggaacccgacccgggaccccctaaccccgtaccgaaaccctaccgtacgaacggtaccgggtaacgggggtaacggaaccgggggtaccgggggtaagtaccggggaacccgggtaaccccgttaatttaacgttacggtcggtacgggtagggttaggggttagggttaaagttaagggtttcgggttagggtagtacgtaccgtaccgtacccttaagtacccggtttacggttaaccgggaacgggttacccgggaaaaccgttacggttcccgttacccgtacccgtacgtaccgaaccgtaccccgaacggaaccccctaacccagttccgaacctcccttcgttacccctaccccc

SEQ ID NO: 433534 - DNA, 733 bp, Homo sapiens
  misc_feature: GZ8MTXP02I32CZ.4.57.F02.1.454.CMB.2.raw
  modified_base (300)..(300): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaagtgtacattggtacaggcagaagccaggccaggcccctgtggtggtcgtccgttangatagccgacccggcctcgagggactccccgtgacgcgtacttcccgtcgtcgggtcctaccctaaacgtccggttacggggaacctacccggggacccctaaccccgttacggaaccccaagttccgaacgggacccggaagggggttacccggaaaacgggggccccgggggtaatacggggaacggggtccccggtaaactttaacgtttaaccgtggtaccgtaagggggttggtaggggtaagttagggtaggttgggtagtaagtcctaacgtcccgtaagttaccggttacgttaccgggtaaaacgttcgggggaaaccgtaaacgggttcccgtacccggttacccgttaaccgtcccgaaccggaccccgaaaacgggacccctaaaccttacccgtaacgtccgtaacctacccgtttcccg

SEQ ID NO: 433535 - DNA, 717 bp, Homo sapiens
  misc_feature: GZ8MTXP02I5U4U.4.57.F02.1.454.CMB.2.raw
  modified_base (297)..(297): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacagttggtacaggcagaagccaggccaggcccctgtggtgtcgtccgttangatagcgaccggcctcgagggactccctgagcgattctctggcctccaaactcgtacgggaaccaccgggccctaccctcggaacccactccgaacggccgagggggtaccggaaacgggcccgggggaatcgggaacggggacccgtaacttacgttaacgtcggttacgagggttggtagggggaattaagggttaaggttgggtagtaagtccgtaacgtccgtaacgttaccggtaccgtttaccgggaaacgttacgggggaaccctaaaacggggttcccgttaccccggttacccgttaaaccggttacccgaaccgggacccccgaaacggggaccccccaaaacccccggtaaccttccggtaccccaaacccgtttcccgtacccggtttaccccccttaaacccccccg

SEQ ID NO: 433536 - DNA, 738 bp, Homo sapiens
  misc_feature: GZ8MTXP02HOVOR.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaggtaaaagtgtacattggtacaggcagaagccaggccaggcccctgtggtggtcgtccgttatgatagcgaccggccctcgaggggactccccgtgacgcgtatttcccgtcgtaggcctcctaactccgttacggggaccaccgggcccaccctcgacccagtcacgcgaggggtaccggaaacggcccgggggattcgggaacgggcccgtaacgttaacgtttaaccgtgttaccgaaggggtttggggttaggggtaagtttaaagggttagggttggggttagtaaaggttccgtaaacttcccgtaaacgtttaccggttaccgttttaccggggaaaaccgtttcgggggaaaaccccgttaaaaggggttcccgtttccccgggttacccgtttaaaaccggggttcccaaaaccggtacccccgaaaccggggaccccctaaaacccgtttccccaaaccgggtttccgttacccgtaacccgttttccccg

SEQ ID NO: 433537 - DNA, 562 bp, Homo sapiens
  misc_feature: GZ8MTXP02IV7PH.4.57.F02.1.454.CMB.2.raw
  modified_base (419)..(419): a, c, t, g, unknown or other
  modified_base (431)..(431): a, c, t, g, unknown or other
  modified_base (464)..(464): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtggtccagcctggggggtccctgagactctcctgtgcagcgtctggattcgccttcagtgcctatggcatgcacgtgggtccgccaggctcccgaggcgaaggggctggaatggggtggctaggttatagttggttagagtaggaactaacaaattctatgacagactcgagacgggcctatcacatctaccaganactaattcgaanacactattagaacttcacagatagaactacgtntaggagacgccggaaggacacgggactcggttataacgtttacgtggtgtaacgaaggtaaggtagtcgggtatacggttcggtttacccgtttacgg

SEQ ID NO: 433538 - DNA, 538 bp, Homo sapiens
  misc_feature: GZ8MTXP02JIACN.4.57.F02.1.454.CMB.2.raw
  modified_base (341)..(341): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggaggcgtggtccagccgtgggggtccctgagactctcctgtgcagcgtctggattcgccttcagtgcctatggcatgcacgtgggtccgccaggcctccgaggcgaaaggggctggaagtggggnggcagttatagtggtttgataggaactaacaaattctatgcagactcgtgagggccattcaccatctccagacgactaattcgagaacacattagaatctagagtatagaacagtcagagtacgaccgagacgacggctagtactagttacgtgtgtacgaagaggttaagtcggtactacgtcggttcgtttacgg

SEQ ID NO: 433539 - DNA, 718 bp, Homo sapiens
  misc_feature: GZ8MTXP02GQHJN.4.57.F02.1.454.CMB.2.raw
  modified_base (223)..(223): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccngcatcggaaggtaaaagtgtacagttggtacaggcagaagcaggccaggcccctgtggtgtcgtccgttatgatagcgaccggcccgtcgacggagtccctgagacgtatctctcggctccaactcgtgggaaccacggccaccctcgaccgactcgagcgacggggtacggaacggaccgggggagtacggacgggacccgtacgtaacgtttaaacgtcggtaccgtagggttggttagggggtaagttaaagggttagggttaggggttacgtaggttactaacgttaccgtaacgttaacggtttaccgttaccgggtaaaccggtacggggtaacccgtaaacgggttaccgttacccgggttacccttaaaccgggttccgtaaccggtaacccccggaaacccggggacccctaaaacccccggtaacccttacgggttacccgtaccctttaccgtttcccggtttaacccccgtttaacccccccg

SEQ ID NO: 433540 - DNA, 569 bp, Homo sapiens
  misc_feature: GZ8MTXP02FV2FB.4.57.F02.1.454.CMB.2.raw
  modified_base (227)..(227): a, c, t, g, unknown or other
  modified_base (370)..(370): a, c, t, g, unknown or other
  modified_base (422)..(422): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcagtcggaaggtaaaagtgtacagttggtacaggcagaagccaggccaggcccctgtggtggtcgtcgtatgatgccgaccggccctcgagggactccccgtggacgcgtattccctctggctaccaactcgtacgggaccncggccacccgtgaccatcagcagggtcgaaggcgggatgagccgatatacgngtcgagggtgtagggataggtagtgggtagacgtcactcctaagtaccgttcgttaccgggaacgtacggggaacctaagggtcctaccgtccgtacgtccacgacccgaaaggccccaaaactcccgacttcacctacgtttcccg

SEQ ID NO: 433541 - DNA, 631 bp, Homo sapiens
  misc_feature: GZ8MTXP02JAKUA.4.57.F02.1.454.CMB.2.raw
  modified_base (254)..(254): a, c, t, g, unknown or other
  modified_base (293)..(293): a, c, t, g, unknown or other
  modified_base (357)..(357): a, c, t, g, unknown or other
  modified_base (372)..(372): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacnggcagaagccaggccaggcccctgtggtgtcgtccgtangatggcgaccggcctcgagggactcccgtgacgcgattctctcggcctccaactctacggaacncggccaccctgaccntcagcagggtcgaaggcccggggatcggaggccgactacttacgtgtcagggtgtagggactaggtaggtgggtagtagtacaattcccgaagttaccggttacgttaccggggtaaccgttcgggggaaaccctaaacgggttcccttacccggtacccgttaccggtaccgaaccggacccccgaaacgggtacccccaaaacccccgcgttaccggtaccctaaccgttcccgttacccggttccccccgtccccc

SEQ ID NO: 433542 - DNA, 638 bp, Homo sapiens
  misc_feature: GZ8MTXP02GBH8Q.4.57.F02.1.454.CMB.2.raw
  modified_base (205)..(205): a, c, t, g, unknown or other
  modified_base (299)..(299): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccncaggctccaggcaaggggctggaatgggtgcagttatagtggttgatggaaactaacaaattctatgcagactccgtagaaggccatcacatcncagagactaattcgagaacactattagaactctaacagtatacgaacagtctagagacgccgaggaccacgggtcttacgtacttaatttagtggtgacgtaagtaagttaaagttggtctagttcggtttaccttttacggaccgtagggtcggggaccgtaacggggtaacccttgggtacctacccggtctccctacgacgtccttacccgaaccgtaccgggccctacgtcccggttccccttcccccgtggtccccgtcccgtcgtcccgttccgaacggaccgtcccgtacccggttcggtacgggggccaaccgccgggcccggtccccggg

SEQ ID NO: 433543 - DNA, 591 bp, Homo sapiens
  misc_feature: GZ8MTXP02HNXQE.4.57.F02.1.454.CMB.2.raw
  modified_base (278)..(278): a, c, t, g, unknown or other
  modified_base (351)..(351): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggccaggataacctgtgtgggaaccagcagtcggaaggtaaaagtgtacattggacaggcagagcaggccaggccctgtggngtcgtcgtatgatgcgaccgcctcagggctccctgacgcgattctctcggcctccgaactcgtacgggaaccnccggcccaccctgaccatcaggcgacgggcgaaacggccggggatggacggccgtatacttcgacgtcgacgggtgtagggattaggtaggttgggcgtaactcgaactcccgtaagtaccgttcgttacgggaaacgtcgggaacccgtaaggttccctccgtacccgttacggacaccggacccgaaacggccccaaaccccacgtcgtaccaccttccgtccttaccccctaccccg

SEQ ID NO: 433544 - DNA, 562 bp, Homo sapiens
  misc_feature: GZ8MTXP02H47TC.4.57.F02.1.454.CMB.2.raw
  modified_base (299)..(299): a, c, t, g, unknown or other
  modified_base (489)..(489): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaggtaaaagtgtacattggtacaggcagaagccaggccaggcccctgtggtgtcgtccgttangatagcgaccggcctagagggactccccgtgacgcgtattccgtctcggctccaacgtcgtacggggaccacgggcccaaccccgtgacccatcgagccgagggtcgaacggccggggatggacgggccgactacgtactgtacgagggttgtagggattaggtaggtgggtgatcgatccattaccgtntacggaacgtgggacctaaggtcctaccgtcctacgtcacgcccaaggcccaaacgtccactcgtctactccg

SEQ ID NO: 433545 - DNA, 580 bp, Homo sapiens
  misc_feature: GZ8MTXP02GMCLU.4.57.F02.1.454.CMB.2.raw
  modified_base (385)..(385): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaaactaacaaattctatgcagactcgtgaaggccgattcacatctccagagactaattcgagaacacattgaatctacagatagaacagtctggagacgccgagacacggctgtctattatgtgngagagtagtgtcagtgtctttgactaggtcgggcgaggaccgtggtcaccgtcctccgtacacgtccttaccaccgtaacggggcccctaacggttccggtccccgtttcccccgtcgggtcccgtccccgttcgccccgtccgacggtaaccgcccgtaccgtcggtacgggggccaacggacggtccccgggg

SEQ ID NO: 433546 - DNA, 569 bp, Homo sapiens
  misc_feature: GZ8MTXP02GAWK0.4.57.F02.1.454.CMB.2.raw
  modified_base (227)..(227): a, c, t, g, unknown or other
  modified_base (340)..(340): a, c, t, g, unknown or other
  modified_base (366)..(366): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtggtggaaccngcatcggaaggtaaaagtgtacattggacaggcagaagccgaggccaggcccctggtggtggtcgtccgttatgatagcgaccgcctcgaggactcccgtgacgcgtattccnctggcctaccaacttccgagggaccnccggcccaccctgacccatcgacgcgagggtacgaacggccggggagtggacggccgaactattacgtgtacgagggtgtaggggattaggtagtgggtagatcgactccgtagtacgttacgttcgggaactacgggaccgtaaggtccgtaccgtacctacgtccacgacccaacggtccaactccgactcgcacgttccg

SEQ ID NO: 433547 - DNA, 546 bp, Homo sapiens
  misc_feature: GZ8MTXP02IT6NV.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggaggcgtggtccagcctgggggtccctgagactctcctgtgcagcgtctggattcgccttcagtgcctatggcatgcacgtgggtccgccaggctccgaggcaaggggctggaagtggggtgcagttatagtggtttgataggaactaacaaattctatgacagacctccgtagaacgggccgattcaccatctaccagacgaactaatttacgagaacactattagaatactacagatagaacagtactagagacgacgaaggacgacggctacgtcttattattcgtgacgaagtagtaagtcgtagtacgttcggttacgtttacgg

SEQ ID NO: 433548 - DNA, 596 bp, Homo sapiens
  misc_feature: GZ8MTXP02HNT0K.4.57.F02.1.454.CMB.2.raw
  modified_base (460)..(460): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtaacattggtacaggcagaagccaggccaggcccctggtggtggtcgtccgttatgatagcgaccggccctcgaggggactcccgtgagccgtattccctcgtggcctaccaactccgttaggggaccaccgggcccaaccccgtcgacccatccaacggcgaggggtccgaaaggcccgggggatcggacggaccggaacttacgttaccnggtcgagggtgtggggaattagggtagtgggtgactgactcgataccgtcgttcgggaaacttgggacccgtaaggttcctccggtcctacggtcacgacccaacggcccaaacgtccaactcgtaccacttcccg

SEQ ID NO: 433549 - DNA, 609 bp, Homo sapiens
  misc_feature: GZ8MTXP02HFJWO.4.57.F02.1.454.CMB.2.raw
  modified_base (461)..(461): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaagtgtacattggacaggcagaagccaggccaggcccctgtggtggtcgtccgttatgatagcgaccggccctacgagggactccccgtgacgcgtattccctcgtcggctccgaactccgtaggggaccaccgggcccaccccgtgaaccctatccgacggcgacggggtaccggaaagggcccgggggatcgggacggtcccggaacttagttaccgngtacgaggggtgttaggggattagggtagtgggttagactcattaccgagttacgtcgtttacggaacgttcgggaaccctaaggttcctaccggtcctacgtccacgacccaacggcccaaccgtcccaacgtcgtacctacttccg

SEQ ID NO: 433550 - DNA, 691 bp, Homo sapiens
  misc_feature: GZ8MTXP02JOETB.4.57.F02.1.454.CMB.2.raw
  modified_base (205)..(205): a, c, t, g, unknown or other
tcagagcactgtagcacgaccggtgctcgatttagctcgatatagttgggtttggggggaagaggaagactgacggccctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaaggggctggaatgggtggcagttatatggtttgatggaactaacaaattcatgcagactccgtggaacggccgtattccaccatcctccaagagaactaactttcggaacgtaaaccaactatttagaaacttctaaacagaatacggaaactagtactagaaggacgccgagggaccgacgggtcttgtcttaatttagttcggtgtacggtaaggtaagttaaggtggttactagttcggttaccgtttttaggacccgtagggttcgggggacccgtacggggtaaaccccgttcgggtaccctacccggttccttacccgtaccgtaccggtacctttacccgaaccggaaccggggtacccctaacgttcccgggttccccttcccccggtcggccccgccccgttcgcccgttccgacggacgtcccgaccgttcggacgggggacaccggcggcccggtcccggg

SEQ ID NO: 433551 - DNA, 665 bp, Homo sapiens
  misc_feature: GZ8MTXP02HWDBG.4.57.F02.1.454.CMB.2.raw
  modified_base (312)..(312): a, c, t, g, unknown or other
tcagagcactgtagcacgaccggtgctcgatttagctcgatatagttgggtttgggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtcccgccaggcctccaggcgaagggggctgggaatggggtggcagttatagtggtttgataggaaactaaacaaattctaatgcagactccgtagaagggccatcaccntcctcagagacaatttcgagaacactattgaatctaacagatagaacagtctagagaggccgagggacacggtctgtactattattcgtgcgagagtaaggtggtacgtagttcggttctttgaccgtaggtcggggaccgacggggtaacccgtgggtaccaccggtcctcctccgtacgtaccttacccgaaccgtaaccgggtcccctaacgttcccggttcccgtttccccccgtcgggtccccgtcccccgtcggtccccgtacccgtaacgggtaccgtaacccgaccccggttccgggttacggggggaccctaaacccgggacggtaccccggggtcccccgggg

SEQ ID NO: 433552 - DNA, 579 bp, Homo sapiens
  misc_feature: GZ8MTXP02HYQ3F.4.57.F02.1.454.CMB.2.raw
  modified_base (153)..(153): a, c, t, g, unknown or other
  modified_base (227)..(227): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcagccaccctcagtgtcagtggccccagggcagacggccaggataacctgtgtaggaaccngcagtcggaaggtaaaagtgtacattggtacaggcaagaacgccgaggccaggcccctggtggtggtcgtccgttatgatagcgaccgccctgaggactcccgtgagcgattccctctcggctccaactcgacgggaccaccgggaccaccccgtgaacccagtacagaccgaggggaccgaaacgggccggggagcggacgggaccgacttaacgttaacgtgtacgaggttggtagggggaattaggtaggtggtgatacagtccagttacgtcgttacgacgtacggacgtacggtcctaccgtcctacgcgacgacccgaagacccaacgtccactcgacctactccg

SEQ ID NO: 433553 - DNA, 524 bp, Homo sapiens
  misc_feature: GZ8MTXP02H9PJT.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggaggtcgggggagcgtggtccagccgtggggggtccctgagactctcctgtgcagcgtctggattcgccttcagtgcctatggcatgcacgtggtccgccaggctccaggcaaggggctggaatggggtggcagttatagtggtttgatggaactaacgaattctatgcagactcgtgaagggccgattcacatctccagagactaatttacgagtaacactacttagaactctacagatagaacagtctagagagctaggacacggctcgtactatacttagtgcgaagagtaagtggtacagttcggtactttcg

SEQ ID NO: 433554 - DNA, 590 bp, Homo sapiens
  misc_feature: GZ8MTXP02FSR0Z.4.57.F02.1.454.CMB.2.raw
  modified_base (359)..(359): a, c, t, g, unknown or other
  modified_base (368)..(368): a, c, t, g, unknown or other
  modified_base (379)..(379): a, c, t, g, unknown or other
tcagagcactgtagcacgaccggtgctcgattagctcgatatagttgggtttgggctgggcctaaggaagcagcactggtggtgcctcagccatggcctggaccgttctcctcctcggcctcctctctcactgcacaggctctgtgacctcatatgtgctgacctcagccacctcagtgtcattgccccgaggcagacgccaggataccctgtgtgggaaccagcatcggaagtaacgtgtacatggtacaggcagagccaggccaggcccctgtggtggtcgtccgttatgatagccgaccgccctcagggatcccgtgagcgtattcccgtctggcctaccacttccgcgggacccncccggcccncccgtcgaccnctcgacgacgtacgggtacggaacgggacggggtacgtacgacgaccgtacgttacgttacgtcgtcgtaggtggtggtagtagtaggttggtgtcgtctactacgtacgtaccgtacgtacgtaacggtacggtaccgtaccgtccgtcccgtaccgtaccgtaccgaccgacccgaaccgaccgacctacctactcgtacctacctccg

SEQ ID NO: 433555 - DNA, 539 bp, Homo sapiens
  misc_feature: GZ8MTXP02H4VCA.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggagcgtggtccagcctgggggtccctgagctctcctgtgcagcgtctggattcgccttcagtgcctatggcatgcacgtgggtcccgcaggcctccaggcgaaggggctggaatggggtgcagttatagtggtttgagtaggaactaaacaaattctatgcagactcgtagaacggccgatcacatctcagagactaattcgagaacacattagaatctacagatagaacagtctagagacgcgaacggacacggctagtcttaagttacttcggtagcggtaagtagttaaagtcgggtactagttcggtttaccctttagg

SEQ ID NO: 433556 - DNA, 627 bp, Homo sapiens
  misc_feature: GZ8MTXP02H8B6V.4.57.F02.1.454.CMB.2.raw
  modified_base (210)..(210): a, c, t, g, unknown or other
tcagagcactgtagcacgaccggtgctcgatttagctcgatatagttgggtttggggggaagaggaagactgacggtccctcccaggagttcaggtgctgggcaccgtgggcagtgggggaggcgtggtccagccgtggggggtccctgagactctcctgtgcagcgtctggattcgccttcagtgcctatggcatgcacgtgggtcccnccgaggcctccgagggcgaaggggctgggaatggggtgctagttatagtggtttgataggaaactaaacaaattctatgacagacctccggtagaacgggccgattccaccatcctaccagacgaactaatttcgaagaaacactattagaaatctaaacagatacgaactagtctagagagcccgagaccacggcttagtactagttatgagtacgagtaagtaagtgtacgtagttcggttcctttagacgtagggtcgggaccgacgggtaacccgtggtaccctaccggtcctacctcgacgtccttaccgaccgaaccggccctacgtcccggttccctcccgtcggcctcccgtcgccgtccgaggtacgcccgtcccgtacgggcggggaccaccgacggtccggcccgg

SEQ ID NO: 433557 - DNA, 657 bp, Homo sapiens
  misc_feature: GZ8MTXP02IJ7AU.4.57.F02.1.454.CMB.2.raw
  modified_base (221)..(221): a, c, t, g, unknown or other
  modified_base (296)..(296): a, c, t, g, unknown or other
  modified_base (369)..(369): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccaggcaggacgcaggataacctgtgtaggaacngcagtacggaaggtaaagtgtacagttggtacaggacagaacgcaggcacggcccctggtggtggtcgtcgttangatagccgaccggccctagagggtactcccgtagacgcgtattctcgtcggcctaccaactcgtagggaaccncgggccctaccctgaaccctatccgagacgacggggtacgaacgggcccgggggaatacggacgggacccgtaacgttaacgtttacgtcggtacgtaggggtgtaggggaacttagggtggttaggtgatacacgttcccgaagttacgttcgttacggaacgtacggggaaacctaacggttcctacccggtacttaaccggacaccggacccccgtaaaggaccccctaaaaccccgtcgttacggtacccaacctttccggttacccgtttaccccaacccccg

SEQ ID NO: 433558 - DNA, 653 bp, Homo sapiens
  misc_feature: GZ8MTXP02JTQEH.4.57.F02.1.454.CMB.2.raw
tcagagcactgtagcacgaccggtgctcgatttagctcgatataggttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcgaggtgcaccgtgggtggaggtcgggggaggcgtggtccaggccgtgggggtccctgagactctcctgtgcagtcgtctggattcgccttcagtcgcctagtggcagtgaccgacgtcggtccgcgaggctcccgaggcgaaacggggctgggaaacggtggggtagacgtaaggtttatacgtttgggtttagaagttaacgggaaacttaaaactaattccgtatcggacgtaacgtaccgtaccggtaggaacggggaccctattacccacgtactcctaccgaagtacgaacttaaacgttacgaacgaaacacgtaagttacgaataccgtaacgaagagttacgaaacctgtacagacgaacgcgaacggtacgacggtacttcggtacttagttactggtacgaggaaggtaaggttacggtacggtactacggtttcgttacctttacggg

SEQ ID NO: 433559 - DNA, 516 bp, Homo sapiens
  misc_feature: GZ8MTXP02GYFAS.4.57.F02.1.454.CMB.2.raw
  modified_base (357)..(357): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcaggggactcccgtgagcgattcctctggctccactctgggacncggccacctgaccatcagcgagggtcgaagccgggggatggacggccgactagttactgtcgaggtgtgggatagtagtggtgatcatcatacgtctacggaactgggaccaggtctccgtcctacgtcacgcccaaggcccaactccactcgcactcc

SEQ ID NO: 433560 - DNA, 559 bp, Homo sapiens
  misc_feature: GZ8MTXP02FG7NL.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggcccctgtggtggtcgtccgttatgatagcgacccggccctcagggactccctgagcgattctctcggcctccaactcgtagggaacacgggcccaccctgaccatcagcgagggtcgaaggcccggggatggacggccgactattactgtcagggtgtagggataggtaggtggtgagtcatccattacgtcttacggaacgtcgggaaccaaggtcctcccgtacctacgtacacgacccaacggccccaaaccccgactcgtacacctctccgttcccctacccc

SEQ ID NO: 433561 - DNA, 785 bp, Homo sapiens
  misc_feature: GZ8MTXP02HN611.4.57.F02.1.454.CMB.2.raw
  modified_base (212)..(212): a, c, t, g, unknown or other
  modified_base (214)..(214): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggcaggataacctgngnggaaccagcagtacggaagtaaagtgtacagttggacaggcagaagccaggccaggccctgtggtgtcgtcgtatgatacgcgaccgccgtcgaggtactcccgtagacgcgtacttcgtcgtccggcctaccgtaaccgttacggtacggggaacccgaccgggccccctaacccgttacggaccctactccgaacgggccgaaacgggggttaccgaaaacggggcccgggggtaatacgggggaacggtcccgtaacgttaacgtttacggtacggtacggagggggttaggttagggggaagtttagggtaagggttggggtagtaaacggttaccaacgttacccggtaacgtttacccggttaccggtttaaccgggaaacggtttaccgggggaaacccgttaaacgggggttacccctttcccgggtaacccccgtttacgggttacccgaaacccgggccccggtaaaaacccccgggccccctaaaaacccccggtaccttcggggttaacccctacccgtttaccccgtttccccggtttaaaccccccctttccccccg

SEQ ID NO: 433562 - DNA, 540 bp, Homo sapiens
  misc_feature: GZ8MTXP02H5I5N.4.57.F02.1.454.CMB.2.raw
  modified_base (355)..(355): a, c, t, g, unknown or other
  modified_base (447)..(447): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtacggaaggtaaaagtgtaacagttggtacaggcagaagcaggccaggcccctggtggtggtcgtcgtatgatagcgacgcctcgaggctccctgagcgatctctcggctccaactcgtaggaacnccgggccacctgaccatcagcagggtacgaaggcgggatgggagccgaacgtattacgtcgtacgagggtagtgggtaataggtaggttggngatcgatcattacgtcttacggagtggaaccagtcctcgctagtcacgacccaaggtcccaacccgatcgacctactcctacgttcccacccc

SEQ ID NO: 433563 - DNA, 683 bp, Homo sapiens
  misc_feature: GZ8MTXP02HTIZM.4.57.F02.1.454.CMB.2.raw
  modified_base (377)..(377): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacggccaggactaaccgtgtgtgggaaccagcagtcggaaggtaaagtgtaactagttggtacaggcagaacgccaggccacggcccctggtcggtggtcgttcgttatgatacgccggacccggcctcgagggtactcccgtgacgcgtactctcgtcgcctaccactcgtacggaaccncggccctaccgtacgacctactcgacgacgacggggtacgaaacgggccggggatacgggacgggacccgtacgttaacgttacgtcggtacgaggggttggtaggggtaagttagggttaggttgggtaggtaactaccgaacgttcccgtaagttacccggttcggttaaccgggaaaccggttacggggaaccgtaacgggttccgttccgtacccgtaacggttaccgaccgaaccccgtaacggacccctaacccccgtacgtccgttaccacgtttcccgttccgttcccccgtcccccg

SEQ ID NO: 433564 - DNA, 547 bp, Homo sapiens
  misc_feature: GZ8MTXP02HZZ2X.4.57.F02.1.454.CMB.2.raw
  modified_base (303)..(303): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggccctcctctctcactgcacaggctctgtgacctcatatgtgctgactcagccaccctcagtgtcagtggccccagggcagacggccaggataacctgtgtgggaaccagcagtcggaaggtaaaagtgtaacattggtacaggcagaagccaggccaggccccctgtggtggtcgtccgttangatagcgaccggccctcagggatccctgagcgattcctctggctccaactcgtacggggacaccggccaccccgtgacccatcagcgagggtacgaaggccggggatggacggccgactatacgtgcgaggtggtgggataggtagtgggtgatcgatccattacgtcgtacggaacgtcgggacctaaggtcctccgtcctacgtcacgacccaaggcccaaactcccacgtctctaccttcc

SEQ ID NO: 433565 - DNA, 640 bp, Homo sapiens
  misc_feature: GZ8MTXP02HNL41.4.57.F02.1.454.CMB.2.raw
  modified_base (350)..(350): a, c, t, g, unknown or other
  modified_base (362)..(362): a, c, t, g, unknown or other
  modified_base (399)..(399): a, c, t, g, unknown or other
  modified_base (415)..(415): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaagggggctggaatggggtgctagttatagtggtttgataggaaactaacaaattctaatgcagactccgtaggaaggccgtattcaccatcctccagagactaatttcgaagaacactattgaaatctaanagatacgaaacngtctagagacgcgaggacacggctgtacttatattgngcgagtagtaagtgtntagtcgttctttgaccgtaggtcgggaccgtaacgggtaaccctggtacctacccggttctcccgtcacggtcccttaccgaacccgaacgggtacccctacgttccccggttccctttccccccggtggtccccgtccccgttcgtacccgttacccgaacgggacctcccggtacccgttcggggtaccgggggaccaaccggccgggtcccggtccccgggg

SEQ ID NO: 433566 - DNA, 529 bp, Homo sapiens
  misc_feature: GZ8MTXP02FPENA.4.57.F02.1.454.CMB.2.raw
  modified_base (431)..(431): a, c, t, g, unknown or other
  modified_base (459)..(459): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaaagtgtacattggtacaggcagaagccaggccaggcccctgtggtggtcgtccgttatgatagtgaccggccctcgagggactcccgtgagcgattcctctggctccaactctagggaccacgggcccacccgtgaccatcagcgagggtcgaaggccggggatggacggccgatatactgtcaggtgngggatagtaggtggtgatcatcatcgtntacggaactcggaccaaggtcctccgtctacgtcacgcccaaggcccaaactccgaactcgtacacttcc

SEQ ID NO: 433567 - DNA, 549 bp, Homo sapiens
  misc_feature: GZ8MTXP02HMF92.4.57.F02.1.454.CMB.2.raw
  modified_base (177)..(177): a, c, t, g, unknown or other
  modified_base (213)..(213): a, c, t, g, unknown or other
  modified_base (217)..(217): a, c, t, g, unknown or other
  modified_base (272)..(272): a, c, t, g, unknown or other
  modified_base (305)..(305): a, c, t, g, unknown or other
  modified_base (318)..(318): a, c, t, g, unknown or other
  modified_base (443)..(443): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctnagtgtcagtcggccccagggcagacgcaggataacngtgnggaaccagcagtcggaaggtaaaatgtacatggacaggcagaagcagcagcctgngtgctcgtatgatagcgacgcctgaggactccngagcgattccctntcggctacaactcgacgggacaccggccacctgaaccatcagacgagggacgaaacgggccggggaatcgaacggcccgaattaagtaaccgtgtacgagggttgagggataggtagtggggtanatacactactactacgtacgtacggtaacggtacggacgtacgtaccgtaccgtaccgtacgtacgacgaccgaaccgaccaacctacctactactacctactccg

SEQ ID NO: 433568 - DNA, 717 bp, Homo sapiens
  misc_feature: GZ8MTXP02IBXRQ.4.57.F02.1.454.CMB.2.raw
  modified_base (217)..(217): a, c, t, g, unknown or other
  modified_base (332)..(332): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacgcaggataactgtgngggaaccagcagtcggaaggtaaaagtgtacattggacaggcagaaagccgaggccaggcccctgtggtggtcgtccgttatgataggccgaccggccctgaggggactccccgngacgcgtattccccgtcgtcggcctacccgaacttccggtacggggaaccacccgggccccaacccccgtacgaaccccacgtcgaacggccgtaacgggggaccggaaacggggcccgggggaatcggggaacgggtcccgaacgtttaacttacccgttggtaccgtaagggggttggttagggggtatttagggttaggttggggtagaattaccgtacgttacccgtaagtttaaccggttcccgtttacgggggaaaaccgtttcggggaaaacccgttaaaggggtcccttaccccggttacccgttaccggtcccgaaccggaccccgaaaccggaccctaaaccgtcccaacgtttccgtaccctacctttccccgg

SEQ ID NO: 433569 - DNA, 600 bp, Homo sapiens
  misc_feature: GZ8MTXP02HNZW5.4.57.F02.1.454.CMB.2.raw
  modified_base (551)..(551): a, c, t, g, unknown or other
  modified_base (569)..(569): a, c, t, g, unknown or other
tcagagcactgtagcacgaccggtgctcgatttagctcgatatagttagggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcaccgtggtggagtcgggggagcgtggtccagccgtgggggtccctgagactctcctgtgcagcgtctggattcgccttcagtgcctatggcatgcacgtgggtcccgccaggcctccgaggcgaaggggctagggaatggggtgctaggtttatagttggtttagagttaggaaactaaacgtaaatttctagttacgactacggtaacctcccggtaggaaaccggggcccgtaatttcccaacctactcctacccgaagtaacgaactaaagtttacgaacgaaactacgtaattagtaaacttactaacaagtatacgaacgagtctagagacgacgaggacgacggntacgtcttattgtgtcgngaagagtaacgtgtacagttcgttactttcg

SEQ ID NO: 433570 - DNA, 571 bp, Homo sapiens
  misc_feature: GZ8MTXP02JSCBQ.4.57.F02.1.454.CMB.2.raw
  modified_base (298)..(298): a, c, t, g, unknown or other
  modified_base (365)..(365): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcatcggaaggtaaaagtgtacagttggtacaggcagaagccaggccaggcccctggtggtggtcgtcgttangatagcgaccggcctcgagggactcccgtgacgcgtattctctcggcctccaactcgtagggaaccncgggcccaccctgacccatcagcgaggggtcgaaggccggggatggacggccgatactacgtgtcgagggtgtagggattaggtaggtggtagatcagtccgataccggtcgttacggacgtcgggacctaaggtcctccggtacctacgtcacgacccgaacggccccaacccgctacgtccacctccgtaccgtccccgtcccc

SEQ ID NO: 433571 - DNA, 683 bp, Homo sapiens
  misc_feature: GZ8MTXP02IZGQP.4.57.F02.1.454.CMB.2.raw
  modified_base (301)..(301): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacagttggtacaggcagaagccaggccaggcccctgtggtggtcgtcgttangatagcgaccggccctcgagggactcccgtgacgcgtactttcccgtcgtcggtacctccgaaactcggtacggggaaccaccggggcccaaccccgtgaacccacgtccgaacggccgaagggggtaccgaaacggggcccgggggaatcgggaacgggtcccgaaacgttacgttaaccgtgtaccgtaaggggttggtaggggaagtttaggtaggttgggtagtaactcgaagttccctaagttacccggttcgttaaccggggaaactacgggggtaaccctaaacgggttcccgttacccggttacccgtaaccgttaccgaacgaccccgtaaaggcccctaaaaccgtcccaacgtcgtacctaacctttcccg

SEQ ID NO: 433572 - DNA, 553 bp, Homo sapiens
  misc_feature: GZ8MTXP02FN28D.4.57.F02.1.454.CMB.2.raw
  modified_base (431)..(431): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaaagtgtacattggtacaggcagaagccaggccaggcccctgtggtggtcgtccgttatgatagcgaccggccctcgaggggactccccgtgagcgtattccctcgtcggctaccaactcgtagggaccaccgggccaccctgaccatcagcgagggtacgaagccggggatggacggccgactattacngtcaggtggagggataggtagtgggtgatcatcctaatacgtcttacgggaacgtacgggaccaaggtcctccggtacctacgtcacgacccgaaggcccaactccactcgtacactttccg

SEQ ID NO: 433573 - DNA, 518 bp, Homo sapiens
  misc_feature: GZ8MTXP02GBX7G.4.57.F02.1.454.CMB.2.raw
  modified_base (418)..(418): a, c, t, g, unknown or other
  modified_base (449)..(449): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaagtgtacattggtacaggcagaagccaggccaggcccctgtggtggtcgtcgtatgatagcgaccggcctcgacggggatcccctgagcgattcctctggctccaactctgggacacggccacctgaccatcagcgagggtacgacggccggggatggacggccgactattacgngtcgaggtgtagggataggtagtggtgagtnatcatcgtgtcgaactggacaggtctccgtctacgtcacgcccaaggccaactcgactcgacactcccg

SEQ ID NO: 433574 - DNA, 739 bp, Homo sapiens
  misc_feature: GZ8MTXP02G9ASC.4.57.F02.1.454.CMB.2.raw
  modified_base (547)..(547): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggccccaggcagacggcaggataactgtgtgggaaccagcagtcggagtaaaagtgtacagttggtacaggcagaacgcgaggccacggcccctgtggtggtccgtccgttatgatacggcgaccggccctacgacgggactcccgtgacgcgtattcccgtctcggcctaccgtaaccgttccgttacggggaaccgacccgggaccctaaccccgtacgaacccaacgtccgaaacggtccgaaagggggtacccggaaacgggggacccgggggtagtacgggacgggaccccggtaacttagttaaccgtcggtacgtaagggtgggtaggggaagttagggtaagggttggggtanacgttaccgaacttacccgtaagttacccggttacgttaaccgggtaaaacggttacggggtaaacccgtaaacggggttcccttaccccgggttaccgttaacccgttacccggaaaccgtaacccccggaaaacgggaccccctaaacccgtttacccaacgttcccggtacccgtaaccctttccccgg

SEQ ID NO: 433575 - DNA, 590 bp, Homo sapiens
  misc_feature: GZ8MTXP02I542H.4.57.F02.1.454.CMB.2.raw
  modified_base (226)..(226): a, c, t, g, unknown or other
  modified_base (300)..(300): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccngcagtcggaaggtaaaagtgtacattggtacaggcaagagccgaggccaggcccctggtggtggtcgtcgttangatagccgaccggccctcgacgggactcccgtaggacgcgtattccgtctcggcctccaaactcgtacgggaaccaccggcccaacccgtcgaaccagtcaacgcgacggggtacgaacggccggggatggacggcgactagttactagtcgaggtgtagggataggtaggttggatagtcagtaccagttacgtctacgggtaacgtcgggaaccgtacgtcctccgtacgtacgtcaccgacccgaacggaccccaaaccgcttcgcctactccgtccgtcccctccc

SEQ ID NO: 433576 - DNA, 516 bp, Homo sapiens
  misc_feature: GZ8MTXP02FHOIL.4.57.F02.1.454.CMB.2.raw
  modified_base (306)..(306): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtggtccagccgtggggggtccctgagactctcctgtgcagcgtctggattcgccttcagtgcctatggcatgcactgggtccnccaggctccaggcaaggggctggaatggggtgcagttatatggtttgatggaactaacaaattcatgcagactcgtagaagggccgattcaccatctccagagactaattcgaagaacacattagaatctaacagatgaacagtctgagagcgaaggacacggctgtctattagtgtgacgaagagtaagtcgtactagtcgtctttacg

SEQ ID NO: 433577 - DNA, 700 bp, Homo sapiens
  misc_feature: GZ8MTXP02JEX5K.4.57.F02.1.454.CMB.2.raw
  modified_base (369)..(369): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcggccaccctcagtgtcagtcggccccagggcagacggccaggataacctgtgtggaacagcagtcggaaggtaaaagtgtaacagttggacaggcagaagccaggccaggcccctggtggtggtcgtcgttatgatagcgaccgcctcgagggactccctgacgcgtattctccgtggcctaccaacttcgtagggaaaccnccggggacccacccgtacgaacccatcgacgaccgacgggggtacgaaagggcccgggggatacgggacgggtacccgtacttaacttacgtcggtacgtaggggttaggtaggggtaatagggttaaggttggggttaggtaaatttccgaacttacccgtaaaggtttaccgttccggtttaacgggggaaaaccgtccgggggtaaaacccttaggggtccccttaccccggggttaccttaaacccggttccgaaacccgcccccgaaaacgggtccccaaaacccggttccaacgttcgtaaccctaccggttctttaacccccgg

SEQ ID NO: 433578 - DNA, 610 bp, Homo sapiens
  misc_feature: GZ8MTXP02HSJSB.4.57.F02.1.454.CMB.2.raw
  modified_base (213)..(213): a, c, t, g, unknown or other
  modified_base (219)..(219): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcagtcggcccagggcagacggcaggatacctgtgnggaacngcatcggaaggtaaagtgtacattggtacaggcagagcaggccaggccctggtggtggtcgtccgtatgatacgcgaccggcctcgagggactcccgtgacgcgtacttctcgtcggcctccaacgtcgtacgggaaccacgggcccacccgtcgaccacgtcacggcgacggggtacgaaacggcccgggggatcgggacggaccgtaacttacgttacgtgtacgagggtggtagggtagtaggtaggtggtatagtcaagtccagttacgtcgttacggaacgtcgggaaccgtaacggtccgttaccgtaccttacggaccacggacccaaccggaccctaaaccccgtacgtcgtaccctacgttccgtccgtttcccccgtcccc

SEQ ID NO: 433579 - DNA, 659 bp, Homo sapiens
  misc_feature: GZ8MTXP02ID3IY.4.57.F02.1.454.CMB.2.raw
  modified_base (221)..(221): a, c, t, g, unknown or other
  modified_base (229)..(229): a, c, t, g, unknown or other
  modified_base (304)..(304): a, c, t, g, unknown or other
  modified_base (375)..(375): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgngggaaccngcagtcggaaggtaaaagtgtacattggtacaggcaagagccaggccacggcccctggtggtggtcgtccgttangataggcgaccggccctcgagggactccccgtggacgcgtattccctctggcctccaactcgtagggaccncggcccaccctgacccatcagcgagggtacgaacggccgggggatcgggacggcccgtaacgttacttacgtggtacgtaggggttcggtaggggtaatttagggtaggttggggtagtagttacacttcccgtaagttaccggttcgtttaccggggaaaccgttacgggggtaaaccctaacgggttcccgtccccggttacccgttaccggtaccgaccggacccccgaaagggccccctaaaaccgttcccaacgttccgttacctaacgtttttccccg

SEQ ID NO: 433580 - DNA, 599 bp, Homo sapiens
  misc_feature: GZ8MTXP02JQFJU.4.57.F02.1.454.CMB.2.raw
  modified_base (299)..(299): a, c, t, g, unknown or other
  modified_base (389)..(389): a, c, t, g, unknown or other
  modified_base (486)..(486): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacgccaggatacctgtgtggaaccagcagtcggaaggtaaaagtgtacagttggacaggcaagaagccaggccaggcccctggtggtggtcgtcgttangatagcgaccgcctgaggactcccgtgacgcgtattcccgtcgtggacctacctaacttcgagggaccaccgggcccacccgtgacctanccaggcgacggggtaccgaacggccgggggtatcgggaacggtcccgtaacttagttacgtgtacgtagggtggtagggtattaggtaggtgggtanacgtcacgttccacttacggtccgttacggaacgtcgggaacctaggtcccgtaccgtaccgtaccgtacacgacccgaaacggccaaacgttccacgtcgtaccactttccg

SEQ ID NO: 433581 - DNA, 669 bp, Homo sapiens
  misc_feature: GZ8MTXP02H4L9R.4.57.F02.1.454.CMB.2.raw
  modified_base (228)..(228): a, c, t, g, unknown or other
  modified_base (367)..(367): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcaggacggccaggataacctgtgtggaacngcatcggaaggtaaaagtgtacattggtacaggcagaagccaggccaggcccctggtggtggtcgtcgttatgatacgcgaccggccctgaggggactcccgtgacgcgtattccctctggctccaactcgtgggaccncgggcccacccgagacccatcgagacgaggggtccgaacggccgggggatggacgggcccgtaacttagttacgtgtccgtaaggggttggtaggggtaagtttagggttagggttagggtaggtacttacgtacttacccgtaagttacccggttcgtttacccgggggaaacgtttcgggggaaaccccgtaaagggtttcccgtaccccggttacccgtaccgtaccgaccggacccccgaaaacgggtccccctaaaaccggttccccaaacgttcggttaccctaaccgtttccccg

SEQ ID NO: 433582 - DNA, 534 bp, Homo sapiens
  misc_feature: GZ8MTXP02JXKNK.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtcgttatgatagcgaccggccctcgagggactcccgtgagcgattcctctggctccaactctgggaccaccggccaaccctgaccatcacgcaggggtacgaaggccggggatggacgccgactagtactgtcgaggtgtgggataggtagtggttgatacatccattacgtcgttacggaacgtcgggaccaggtcctaccgtctacgtcacgccaacggtccaacgtccgctgtccacgttc

SEQ ID NO: 433583 - DNA, 678 bp, Homo sapiens
  misc_feature: GZ8MTXP02HWQK2.4.57.F02.1.454.CMB.2.raw
  modified_base (197)..(197): a, c, t, g, unknown or other
  modified_base (241)..(241): a, c, t, g, unknown or other
  modified_base (516)..(516): a, c, t, g, unknown or other
  modified_base (615)..(615): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagagtgtccagtgtcaggtncacctggtggagtcgggggagcgtgtccagccgtgggggtcccngagctctctgtgcagcgtctggattcgccttcagtcgcctagtggcatgctacgtcgggtccgcgacggcctccgaggccgaaggggctagggtaagtggggtcgtacgtaggttatacgttgggttttagagtacggtaaaacttaaaccgtaaatttcctaagttgaccaacggtaccttaccgggttaaggaaaccgggtcccgtaatttacccgaaccctatttcccgtaacccgaaaggtaaacgtaacccttaaagtttaccggaaaanaaacctacgtaaagttttaggaaactttacaaaccgtaagaaccgttagaaaccgtagttaccgacggaagaccggacggttaacggacgaacgggttntacgttacttagttacgtcgtagacgtaagtacgtagtcgtacgtcggttacgtttacgtacg

SEQ ID NO: 433584 - DNA, 565 bp, Homo sapiens
  misc_feature: GZ8MTXP02GISLN.4.57.F02.1.454.CMB.2.raw
  modified_base (342)..(342): a, c, t, g, unknown or other
  modified_base (358)..(358): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggaggtcggggggaggcgtggtccagccgtgggggtccctgagactctcctgtgcagcgtctggattcgccttcagtgcctatggcatgcacgtgggtcccgccaggcctccgaggcaaggggctgggaatggggngcagttatatggtttnatggaaactaacaaatttctaatcgacagacctccggtagaaacgggcctagttaccaccaatcctacccaagaacgactaaagtttcgaaagaaaccaactacttagaaacttcaacagaatacgaacagtctagagacgacgaggacacggctacgtactattagttagtgacgaagagtaagtggtacagttcggtctttacgg

SEQ ID NO: 433585 - DNA, 583 bp, Homo sapiens
  misc_feature: GZ8MTXP02F2RW2.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggaggtcggggggaggcgtggtccagccgtggggggtccctgagactctcctgtgcagcgtctggattcgccttcagtgcctatggcatgcacgtgggtccgccaggcctccgagggcgaagggggctgggaagtggggtggctaggttatagttggtttgagtaggaaactaaacaaattctatgacagacctccggtaggaacgggccgattccaccatctacccagacgaactaatttcgaagaacaactattagaactctacagatagaactagtcgtagagagaccgaaggaccgacggtcctaggtacttaagtttagttcgtagtacggaaggtagttaaaggtggtactagttcggttaccttttacgg

SEQ ID NO: 433586 - DNA, 711 bp, Homo sapiens
  misc_feature: GZ8MTXP02G4WVJ.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacggcaggatactgtgtggacagcagtcggaaggtaaagtgtacagttggacaggcagaacgccaggccacggcccctggtggtggtcgtcgttatgatacgccgaccggcctacgagggactcccgtgacgcgtacttcgtcgtcggcctaccaacgtcgtacgggaaaccaccgggcccacccgtacgacccagtaccgagcgaaggggtaccgaagggcccggggatcgggacggtacccgaacttacgttaccgtggtacgaggggttggtaggggtaagttaaggggttaggttaggggtataacgttaccgtaaccgttaccgtaaagttacccgggttaccgtttaaccgggaaaccggtacgggggtaaacccgttaaacgggttccccgttacccggttacccgttaccggtaccgtaacccggaaccccgaaaccgggacccccaaaacccccgtacgttacccggtacctaaccgtttcccgttacccgtttacccccgttccccc

SEQ ID NO: 433587 - DNA, 583 bp, Homo sapiens
  misc_feature: GZ8MTXP02JT6EC.4.57.F02.1.454.CMB.2.raw
  modified_base (284)..(284): a, c, t, g, unknown or other
  modified_base (359)..(359): a, c, t, g, unknown or other
  modified_base (445)..(445): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtaacagttggtacaggcagaagccaggccaggcccctggnggtggtcgtcgtatgatgcgaccggccctcgagggatccctgagcgattctctcggctccaactcgtgggaaccncgggcccacctgacccatcagcagggtacgaaggccggggatggacggccgactattactgtcaggtgtagggataggtagtggtnagtcatccatacgtcttacggaacgtgggaacctaacgggtcctaccggtacccttacggtaccacggtacccccgaaacggacccccaaaccccgacgttacgtacccgtaacctccgtaccgttcccccgtccccc

SEQ ID NO: 433588 - DNA, 644 bp, Homo sapiens
  misc_feature: GZ8MTXP02IVZIX.4.57.F02.1.454.CMB.2.raw
  modified_base (149)..(149): a, c, t, g, unknown or other
  modified_base (212)..(212): a, c, t, g, unknown or other
  modified_base (217)..(217): a, c, t, g, unknown or other
  modified_base (375)..(375): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcagcccaccctcagtgtcaggtcggcccagggcagacgcagatactgtgnggacngcagtcggaagtaaagtgtacagttggacaggacagaacgccgaggccacggcccctggtggtcggtccgttcgttatggagtcggccggacccggccctacggagggtactcccgtgacgtcgtattcgtcgtcgcctaccaactcgtagggaaccnccggcccaccgtgaccatccgaggacggagggtacgaagggccggggatggacggtccgtattacgttacgtgtacgtaggggtggtagggtattagggtaggtggtagtatacgaactccgtagttacggttacgttacgggaacgtacggggaaccttaacgggtcccttaccggttcccgtacggtaccgaccgaaccccgtaaaccggaccccaaaacccgtcgtaccgtaccctaccttcccgttacccgttaccccctacccc

SEQ ID NO: 433589 - DNA, 508 bp, Homo sapiens
  misc_feature: GZ8MTXP02GMFTO.4.57.F02.1.454.CMB.2.raw
  modified_base (153)..(153): a, c, t, g, unknown or other
  modified_base (177)..(177): a, c, t, g, unknown or other
  modified_base (226)..(226): a, c, t, g, unknown or other
  modified_base (247)..(247): a, c, t, g, unknown or other
  modified_base (253)..(253): a, c, t, g, unknown or other
  modified_base (355)..(355): a, c, t, g, unknown or other
  modified_base (357)..(357): a, c, t, g, unknown or other
  modified_base (378)..(378): a, c, t, g, unknown or other
  modified_base (402)..(402): a, c, t, g, unknown or other
tcagagcactgtagcacgaccggtgctcgatttagctcgatatagttgggtttggggctgggcctaaggaagcagcactggtggtgtctcagccatggcctggaccgttctcctcctcggcctcctctctcactgcacaggctctgtgacctnatatgtgctgactcagccaccctnagtgcagtcggccccagggcagacggccaggataacctgtgtggaaccngcagtcggaagtaagtcgtanagtgangacagagcgagcgacgccgtgtggtgtcgtcgtagtgagacgcgcgccgcgagcgcgcgagcgtctctcgcgcgtcacgtcgacgcgcgacacgacgacacncncgcgacgacgacgacggacgngacgacgacgtagtacgtcgtcgngtgtgtagtagtgtgtagagtacgactcgtacgtcgtacgtacgtacgacgtacgacgtcgtcgtcgtacgacgcgacgaacgacgacgtactacgcgcgtcgtcg

SEQ ID NO: 433590 - DNA, 678 bp, Homo sapiens
  misc_feature: GZ8MTXP02GY30T.4.57.F02.1.454.CMB.2.raw
  modified_base (303)..(303): a, c, t, g, unknown or other
  modified_base (382)..(382): a, c, t, g, unknown or other
  modified_base (436)..(436): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagaccggccaggataacctgtgtgggaaccagcagtcggaaggtaaagtgtacagttggtacaggcaggaacgccaggccacggcccctggtggtggtcgtccgttangatagccggaccgccctgacgggactcccgtagacgccgtattccgtcgtcggcctccctaacgtcgtacgggaaaccncgggcccacccgtgaacccatcgagcgtaacgggtacgaaacggcccggggtanacgggacggcccgtaactacgttaccgtggtacgagggttggtagggtagttagggttaggtggggtagattaccgacgttcccgaaagttaccggttaccgtttacgggaaaaccgttcgggggaaaccctaaacggggttcccctacccggttaccgtacgtaccgaccgaccccgaaaccgggaccccaaaccctacgtcggtacctaacccgttcctaccccgtttacccccaccccc

SEQ ID NO: 433591 - DNA, 698 bp, Homo sapiens
  misc_feature: GZ8MTXP02HGA3C.4.57.F02.1.454.CMB.2.raw
  modified_base (211)..(211): a, c, t, g, unknown or other
  modified_base (215)..(215): a, c, t, g, unknown or other
  modified_base (220)..(220): a, c, t, g, unknown or other
  modified_base (295)..(295): a, c, t, g, unknown or other
  modified_base (326)..(326): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacgcaggatacngtgnggacngcagtcggaaggtaaagtgtacagttggtacaggcagaagccgaggccacggcccctggtcggtgtcgtccgtangatagccgaccggcctagacgggactcccgngacgcgtattcccgtcgtcggcctaccgtaactcggtacggggaaccaccgggacccaaccccgttacgaaccctacgtaccgaacgggaccgtaacgggggtaccggaaacggggacccggggggaatacgggggaacgggaccccgggtaaacttaacgtttaaccgtcggttacggaaggggttgggtagggggtaattaaggggtaagggtggggtagtaacgtaccgacttaccgtaacgttaccgttaccggttacgggaaaccggttacggggaaccctaaacgggtcctccccggtaaccgttaccgaccgaaccggacccgaaacggccctaaacctcccgaactcgtaccctacctttcccg

SEQ ID NO: 433592 - DNA, 655 bp, Homo sapiens
  misc_feature: GZ8MTXP02GCKHV.4.57.F02.1.454.CMB.2.raw
  modified_base (305)..(305): a, c, t, g, unknown or other
  modified_base (332)..(332): a, c, t, g, unknown or other
  modified_base (339)..(339): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccaccctcagtgtcaggtcggcccagggcagacggccaggataaccgtgtgtgggaaccagcagtcggaaggtaaaagtgtaactagttaggtacaggcaagaacgccaggccacggccctggtggtggtcgtcgtangatgcgaccggcctcgaggactcccgngacgctntctcgcgcctactacgtcggtacgggaaaccgccggcccctaccgtacgaaccgtacgtaccgacggacgggtaacggggtaccggaaacggggcccggggtaagtacgggacggtacccgtaattacgttacgtcggtacggtagggtggtaggtaagttagggtaggtggtatagtactactacgtacgttacggttacgtacgggaacgtacgggaacctaacggttcccgtccgtacctaccggtacaaccgacccgaaccggtaccccaacccgtcgtacgtacctacctccttacccgttcccctacccg

SEQ ID NO: 433593 - DNA, 525 bp, Homo sapiens
  misc_feature: GZ8MTXP02HLLVR.4.57.F02.1.454.CMB.2.raw
  modified_base (204)..(204): a, c, t, g, unknown or other
  modified_base (452)..(452): a, c, t, g, unknown or other
  modified_base (500)..(500): a, c, t, g, unknown or other
tcagagcactgtagcacgaccggtgctcgatttagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaaggggctggaatgggtggcagttatatggtttgatggaactaacaaattctatgcagactccgtagaaggccgattcaccatctccagagacaatttcgagaacacattgaaatctaacagatgaaacagtctagagacgccgagggtacacggctgtctaattattgtgcgagagtaagtggtcagtcgttctttgacaggtcgggacagggaacctggtcaccgtctctcanctccacacggccatcggtctccccgtgccgcctcgcctccgagcgccncgtcgtcggggcacgcgcgtcccgg

SEQ ID NO: 433594 - DNA, 718 bp, Homo sapiens
  misc_feature: GZ8MTXP02H1MEY.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcacgtgggtccgccaggctccaggcgaaggggctggaagtggggtgctagttatagtggtttgataggaaactaactaaattctaatgacagaccgtccggtaggaaacgggcccgtaattccaacctatccctaccaagaacgaactaaatttcgaaagaaaccactatttagaaacttctaaacagtaatacgaaactagtctaggagacggaccggagggaccaacggtcttagttacttaagtttagtttggtagtacgtaaggtaaggttaaggtcggtactaagtttcggttccgttttaggaccgtaggggtcggggacccgtaacgggtaacccgttcgggtacctacccggttcctcccgtacgaccgtcccttacccgaaccggtaaaccgggccctacggttccccggttacccgttcccccgtcgggtcccctcccgttacgcccgttaccggacggaccgtaaccgtacccgtcggggtcgggggcctacccggcgggtcccggtcccgg

SEQ ID NO: 433595 - DNA, 642 bp, Homo sapiens
  misc_feature: GZ8MTXP02G81ZG.4.57.F02.1.454.CMB.2.raw
  modified_base (279)..(279): a, c, t, g, unknown or other
  modified_base (323)..(323): a, c, t, g, unknown or other
  modified_base (354)..(354): a, c, t, g, unknown or other
  modified_base (610)..(610): a, c, t, g, unknown or other
tcagagcactgtagcacgaccggtgctcgatttagctcgatatagttgggtttgggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccgccaggcctccgagggcgaagggggctgggaagtggggtggctaagttatagttggtttgataggaaactaanaaattctaatgcagactccgtagaaggccatccacatctcaganactaattcgaagaacactattagaatctaanagtatacgaaactagtcgtagaacgacggaccgaggacacgggtctgttacttagtttagtgtagtagaaggtagtaacggtggttctaagttcgggttacttttacggaccgtagggtacgggggtaaccgtaacggggtaaacccgttgggtccgtacccgttcgttacccgtcacggtcccttaccgaaccgtaacgggacctacgtcccggtcccttccccggtcggccctccgtacgccgtaccgacggcnccgtacggtcgacggggcacggcgccggtccg

SEQ ID NO: 433596 - DNA, 564 bp, Homo sapiens
  misc_feature: GZ8MTXP02IAZ2R.4.57.F02.1.454.CMB.2.raw
  modified_base (384)..(384): a, c, t, g, unknown or other
  modified_base (429)..(429): a, c, t, g, unknown or other
tcagagcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactcgtgaaggccgattcacatctccagagacaatttcgagaacacattgaatctaacagatgaacagtctgagagccgaggacacggctgtctattattgtgcgagagtaagtgtcatggttcttttgacctggtggggccagggaccctggtccaccgtctccctnacgtctccaccgaacgggcccacgtcggtccttcccccgtggccnccctcgcctccaggacgccgacctcgtcgggggcacgacggccggcccgtggggcctcggccgttggaccaaacgggtaccttaccttcccgttaacacgtccgcttcgtcggacggtccgggcgtcgggaccgg

SEQ ID NO: 433597 - DNA, 561 bp, Homo sapiens
  misc_feature: GZ8MTXP02GGA1F.4.57.F02.1.454.CMB.2.raw
  modified_base (215)..(215): a, c, t, g, unknown or other
  modified_base (223)..(223): a, c, t, g, unknown or other
  modified_base (276)..(276): a, c, t, g, unknown or other
  modified_base (292)..(292): a, c, t, g, unknown or other
  modified_base (351)..(351): a, c, t, g, unknown or other
  modified_base (440)..(440): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgngggaaccngcatcggaggtaaagtgtacatggtacaggcagaagccaggccaggcccctgnggtggtcgtccgttangatagcgaccggcctgaggactccctgagcgattctctggcctcaactcgtgggaaccncgggccaccctgaccatcagcgagggtcgaaggccgggggatggacggccgactattaacgtgtacagggtgtgggataggtagtggtnagtcactccatacgttctggaaacgtcgggaaccaacgggtctaccgttcctaacgtcacgaccccgaacggacccctaaacccgtactcgtaccacccttcgtccgtttccccccgtccc

SEQ ID NO: 433598 - DNA, 559 bp, Homo sapiens
  misc_feature: GZ8MTXP02GMBFM.4.57.F02.1.454.CMB.2.raw
  modified_base (227)..(227): a, c, t, g, unknown or other
  modified_base (292)..(292): a, c, t, g, unknown or other
  modified_base (472)..(472): a, c, t, g, unknown or other
  modified_base (547)..(547): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccngcatcggagtaaagtgtacatggtacaggcagaagccaggccaggcccctgtgtggcgtcgttangatagcgaccggccctcgagggactccccgtgacgcggtattcccgtctggcctccaaactcgtacggggaccaccgggcccacccgtgacccatccagcgaggggtacaaggccggggaatggacggccgtactattaacgtgtcgaggtggagggtagtaggtaggtgggttgacttnactactagtacgttcgtacggaacgtacggaccgtaggtcctccgtacgtaccgccacgaccgaacgccactccnctcgtctactcg

SEQ ID NO: 433599 - DNA, 646 bp, Homo sapiens
  misc_feature: GZ8MTXP02H8PFV.4.57.F02.1.454.CMB.2.raw
  modified_base (229)..(229): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggacggccaggataacctgtgtgggaaccngcagtacgggaaggtaaaagtgtacagttggtacaggcagaacgccaggccacggcccctggtggtggtccgtcgttatgataggccgaccggccctggacgggactccctggacgcgtattcccgtctcgggtcctaccgaacgttcggacggggaaccacccgggaccctacccccggtagaacccagtaccgaacggaccgtaacgggggaccggaacgggcccgggggaatcgggaaacgggcccggtaatacgttaccgtggtaccgaaggggttggtaggggaagtttaggtaggtgggtatagtcaatcccgagttaccgtcgttacggaacgttcgggaacctaaggttccctacgtccttaaccggcacgacccgtaacggccaaccgtctactcgtactacctcccg

SEQ ID NO: 433600 - DNA, 701 bp, Homo sapiens
  misc_feature: GZ8MTXP02HUOWA.4.57.F02.1.454.CMB.2.raw
  modified_base (389)..(389): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggacggccaggataacctgtgagggaaccagcagtcggaaggtaaaagtgtacagttggtacaggcagaaacgccgaggccgaggcccccgtggtggtggtcgttccgttagtgagtaggccgacccggccctgacgggactcccgtgagcgtattcccgtcgtcggcctaccgaactccgtagggaccnccgggacccaacccgtcgaaccacgtcacggacgagggggtaccggaaggggacccggggagtacggacgggacccgtaacgttacgttacgtcggtacgtagggtggtagggggtattaagggtagggtgggtagtaatacgaactaccgtaagttaccggtacgtttaccggggaaaaccgttcggggaaaacccgttaaacgggtcccgttacccggttacccgtaaccgtccgaaccggacccccgaaaacgggaccccctaaaaccggttcccccaaacgtttccggtacccttaacccgttccccg

SEQ ID NO: 433601 - DNA, 640 bp, Homo sapiens
  misc_feature: GZ8MTXP02I5C33.4.57.F02.1.454.CMB.2.raw
  modified_base (224)..(224): a, c, t, g, unknown or other
  modified_base (295)..(295): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcaggacggccaggataacctgtgtgggaaccngcatcggaaggtaaagtgtacattggtacaggcagaagccaggccaggcccctgtggtcgtcgtccgttangatgcgaccggccctgaggactccctgacgcgtattcctacgtcggcctaccgaaactcgtaggggaaccaccgggcccaccctggaacccagtccagcgaggggtaccgaagggccggggatcgggaacggccgacgttattcgtgtacgagggtgtagggggattaggtaggttggagtactacgaccttccgaagttaccggttaccgttacggaaacggttaccggggaacctaaaacggggttcccgttacccgtaccgtaccggtacgacccgtacccgaaacggtacccccaaccccgacgtttcgaccctacgtcctaccgttaccccttacccccg

SEQ ID NO: 433602 - DNA, 605 bp, Homo sapiens
  misc_feature: GZ8MTXP02G5B2G.4.57.F02.1.454.CMB.2.raw
  modified_base (218)..(218): a, c, t, g, unknown or other
  modified_base (296)..(296): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggcccaggcagacgcagatactgtgtggaacngcagtacggaaggtaaagtgtacagttggtacaggcaagaagccgaggccacggcccctggtggtggtcgtccgttangatagccgaccggccctcgagggactcccgtagagcgtattccctcgtggcctaccaactcgtagggaccaccggcccaccctgacccatcagcgagggtacgaacggccggggatcggacgccgactattacgtgtacgagggtgtagggattaggtaggttgggtagattcgactacccgagttaccgttccgttacgggaacgttacggggaacccttaacgggttccctaccggtacccgtaccgtaccaaccggaccccaaaggcccctaaaaccgtcccaacgtcgtaccctaccgtttcccg

SEQ ID NO: 433603 - DNA, 567 bp, Homo sapiens
  misc_feature: GZ8MTXP02FZVUB.4.57.F02.1.454.CMB.2.raw
  modified_base (343)..(343): a, c, t, g, unknown or other
  modified_base (392)..(392): a, c, t, g, unknown or other
tcagagcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccaggcaaggggctggaatgggtgctagttatagtggttgataggaaactaaacaaattctaatgcagactccggtagaaggccgattcacatctccagagacaatttcgaagaacactattagaatctanagatacgaacagtctagagacgcgaggacacggctgtactattatgtgngagagtaagtgtcagtgttctttgactaggtcgggccgaggaacctggtacaccgtctcctcgacgtccttaccgaaccgaacgggccctacgtccggtcccttcccccgtggccctcccgtcgccgtaccgaggacgccgaccgtcggtacgggggaccacgcggccgtcccgg

SEQ ID NO: 433604 - DNA, 627 bp, Homo sapiens
  misc_feature: GZ8MTXP02JKJZ7.4.57.F02.1.454.CMB.2.raw
  modified_base (177)..(177): a, c, t, g, unknown or other
  modified_base (261)..(261): a, c, t, g, unknown or other
  modified_base (442)..(442): a, c, t, g, unknown or other
  modified_base (497)..(497): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctnagtgtcagtcggccccagggcagacggccaggactaacctgtgtgggaaccagcagtcggaaggtaaagtgtacattggtaacnggcaggaagccgaggccacggcccctggtcggtggtctccgttaatggatacggcgacccggcctcgagggtactcccgtgagcgtattccctcgtcgcctacctactcgtacgggaccgacccgggcccacccgtagaacccatacgacggtccgagggtaccggaagggccgggggtancggacgccgtactacgtcgtgtgtagggtggtaggtagttacggtagtcgggtanacgttacacgttaccgtacgttaccggttacgttacggaacggttacgggtaccgtacggttcccgtaccgtaccgttaccgaccaccgaccgaaccgacctacctccgtacgtaccgtacctaccgttc

SEQ ID NO: 433605 - DNA, 714 bp, Homo sapiens
  misc_feature: GZ8MTXP02HM81N.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccaggcgaaggggctgggaatggggtggctaggttatagtggtttgataggaactaacaaattctatgcagactccgtagaaggccgattcaccatctccaagagactaatttcgaagaacactattagaatctaacagtatacgaaactagtctagagacgccgaggaccacggcttgtacttattattgtgcgaagtagtaagtgtactagttcggttcctttaggaccgtaggtcggggaccgtaacggggtaacccttggggttaccaacccggttccttacccgtacgtaaccggtccctttaacccgaaacccggtaaaccgggtccccgtaaacgttccccggggttaccccctttaccccccggttcggggaccccctcccccggttaccggaccccgttccccggaaacggggtaaccccgtcccgaaaccccgtttccgggggtaccgggggtcccaaacccgggtaccgggtaccccgggtcccccgggg

SEQ ID NO: 433606 - DNA, 613 bp, Homo sapiens
  misc_feature: GZ8MTXP02H27D5.4.57.F02.1.454.CMB.2.raw
  modified_base (216)..(216): a, c, t, g, unknown or other
  modified_base (295)..(295): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacgccaggatactgtgnggaaccagcagtcggaaggtaaaagtgtaacattggtacaggcaagaagccaggccacggccctgtggtgtcgtcgtangatagccgaccgcctcgagggactcccgtgacgcgtattccgtcgtcggcctaccaactcgtacgggaccaccgggcccaacccgtcgaccatcacgcgagggtacgaacgggccggggatgggacggcctaagttactacgtgtacgagggtggtagggattaggtacgggtgggtagacttacagttccaagttacgtcgttacgggaacgtcgggggtaaccctaacgggttccctaccggttacccgttacgcccgaacgacccgaaaaccggtccctaaaaccgttcccacgttcgttacctaacctttcccg

SEQ ID NO: 433607 - DNA, 559 bp, Homo sapiens
  misc_feature: GZ8MTXP02HUSZD.4.57.F02.1.454.CMB.2.raw
  modified_base (209)..(209): a, c, t, g, unknown or other
  modified_base (249)..(249): a, c, t, g, unknown or other
  modified_base (259)..(259): a, c, t, g, unknown or other
  modified_base (352)..(352): a, c, t, g, unknown or other
  modified_base (370)..(370): a, c, t, g, unknown or other
  modified_base (381)..(381): a, c, t, g, unknown or other
  modified_base (386)..(386): a, c, t, g, unknown or other
  modified_base (396)..(396): a, c, t, g, unknown or other
  modified_base (446)..(446): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccnccaggctccaggcaaggggctggaatggggtggcagttanagttggtttnatggaaactaacaaattctatgcagactccgtgaaggccgattcacatctccagagacaatttcgagaacactatgaatctacagatgaaacngtctgagagccgaggacncgctgtctatntgtgngagagtaagngtcagtgtctttgacagtcgggccacgggtaaccgtgtctaccgtctccncgacgtcctccaccgtaacggccctacgtccggtcccttcccccgtcgcccgtcccgtcgtcctaccgacggaacgccgtacccgtcggtacggggccgacgacggccccggg

SEQ ID NO: 433608 - DNA, 639 bp, Homo sapiens
  misc_feature: GZ8MTXP02JZSOX.4.57.F02.1.454.CMB.2.raw
  modified_base (300)..(300): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtacattggtacaggcagagccaggccacggcccctgtggtggtcgtcgttangatagcgaccggccctcgacgggactcccgtgagtcgattcccgtcgtggcctaccaacgtcgtacggggaccaccgggaccctaccccgtgacccagtccgacggaccgaacgggggtccggaaacggggcccgggggtaatacgggacgggcccgtaacgttacgttaaccgtggtacgaggggttggtaggggtagtaggttaggtgggttgaactcgtacgtcccgtaagttaccggttccgttacggaacgttacggggaacctacggggtcctaccggtaccgtaccgtcgacgacccgaacggccctaacgtcccacgtcgtaccacttccg

SEQ ID NO: 433609 - DNA, 580 bp, Homo sapiens
  misc_feature: GZ8MTXP02H7YFF.4.57.F02.1.454.CMB.2.raw
  modified_base (209)..(209): a, c, t, g, unknown or other
  modified_base (244)..(244): a, c, t, g, unknown or other
  modified_base (355)..(355): a, c, t, g, unknown or other
  modified_base (390)..(390): a, c, t, g, unknown or other
tcagagcactgtagcacgaccggtgctcgatttagctcgatatagttgggtttgggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcacgtgggtccnccaggctccaggcgaaggggctgggaatggggtgnagttatagtggtttgatggaaactaacaaattcatgcagactccgtgaagggccatcaccatctcagagactaatttcgagaaacactattgaaatctaacagatagaacngtctgagacgccgagacacggctgtctattattgngcgagagtagtgtcagtgttctttgacgtaggtcggggccgagggtaacccgtcggtcctaccggtctccgtacacgtccttacccgaccgaaccggtccctacgttcccggttcccttccccgtcggtcccgcccgtcgacccgtccgacggaacgcccgaccgttcggacggggccaacgcggcccgg

SEQ ID NO: 433610 - DNA, 625 bp, Homo sapiens
  misc_feature: GZ8MTXP02JAMD1.4.57.F02.1.454.CMB.2.raw
  modified_base (278)..(278): a, c, t, g, unknown or other
  modified_base (293)..(293): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataaccgtgtgtgggaaccagcagtcggaggtaaaagtgtacattggtacaggcagagccaggccaggcccctgnggtggtcgtccgtangatgcgaccggcctgagggactccctgacgcgattctctcggctaccaactcgtacggaaccacgggcccacccgtcgaacccatccgagcgacggggtccgaaaggcccggggatcggacggcccgaacgttacttacgtcgtacgagggtgtaggggataggtacggttggtagactcaatccctaagttaccggtacttaccgggtaacgttcgggggaaccctaaggggtccttcccggtaccgtacggtacgaccgaccccgaaacgggaccccaaaccccgtacgttcggtacctaccgtccgtaccgtttaccccctaacccccg

SEQ ID NO: 433611 - DNA, 653 bp, Homo sapiens
  misc_feature: GZ8MTXP02JHKGK.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggacggccaggataaccgtgtgtgggaaccagcagtcggaaggtaaagtgtacattggtacaggcagaagccgaggccaggcccctggtggtggtcgtccgttatgatagcgacccggcctgagggactcccgtgacgcgtattctcgtcggcctaccaactcgtacggaaaccaccgggcccaccctggaacccacgtcaacggcgacggggtacgaacggccggggatcgggacggcccgtattacgtaccgtgtcgagggtggttggggaattaggtacggttgggtgaattcaagtccgtaacttaccggtcgtttacggaacgttacgggaacccgtaacgggttcccgtaccggttacccgtacggttaccgaccggaccccgaaacggacccccaaaaccccgtcgttaccggacccgtaccgtccctttccgtttaccccctaacccccg

SEQ ID NO: 433612 - DNA, 694 bp, Homo sapiens
  misc_feature: GZ8MTXP02G26L3.4.57.F02.1.454.CMB.2.raw
  modified_base (378)..(378): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccaggcgaaggggctggaatggggtgctagttatagttggtttgatggaaactaactaaattctaatgacagactcggtgaacggccatcaccatctcagagactaattcgaagaacactattagaatctacagatacgaactagtctagaagacgccgaggacncggctgtactatttagtgtgacgagagtaagtggtatagttcggttctttacggaccgtagggttcggggaccgtacggggtaacccgttcgggtaccgtacccgttccttacccgtacctaccggtcccttaccccgaaacccggtaaccgggtaccccctaacggttccccggtttacccccgtttccccccggtcgggtcccccgtacccccgttacgtccccgttacccggaacgggtaacccgccccgttaacccggtccgggggttacgggggaccccaaccgggtacccgggccccgggtcccccgggg

SEQ ID NO: 433613 - DNA, 600 bp, Homo sapiens
  misc_feature: GZ8MTXP02FS2UA.4.57.F02.1.454.CMB.2.raw
  modified_base (213)..(213): a, c, t, g, unknown or other
  modified_base (220)..(220): a, c, t, g, unknown or other
  modified_base (313)..(313): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggcaggatacctgtgnggaaccngcatcggaggtaaagtgtacattggtacaggcagagccaggccaggccctgtggtgtcgtccgttatgatagcgaccgcctgagggactcccngacgcgattctctcggcctaccaactcgtagggaaccaccgggcccacccgtgacctatcgaggcgaacgggggtacgaaacgggcccgggggatacggacgggacccgtaacgttagttaacgtgtacgagggtggtagggtagtagggttagtggtagatacgacgtccaagttaccgttcgttacggaacgtacgggaacctaacggtcctaccgtccgtacgtacgaccgtacccgaacggaccccaaacccgctcgtaccacctccgtccgttcccgtcccc

SEQ ID NO: 433614 - DNA, 616 bp, Homo sapiens
  misc_feature: GZ8MTXP02GA0CD.4.57.F02.1.454.CMB.2.raw
  modified_base (287)..(287): a, c, t, g, unknown or other
  modified_base (404)..(404): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggcctccaggccaagggggctgggaatggggtgcagttatagtggtttgatggaactaaacaattctatgcagctcgngaacggcatcacatctacagagactaatttcgaacgaacactattagaaactccaagagatacgaaacagtcagacgacgcggaggacacgggtcttagtacttagtttagttcggngacgtaaggtagtaaggtgtacgtagttcggtttctttacggactaggggtcgggaccgacgggtacctgggtaccaccgttctactcgacgtccttaccgaaccgacgggtcccagttcccgttacccgtcccgtcggcccgtccctcgcccgtaccgacggccgcccgtaccggtcggtacggggacccacggtccggtcccggtcccgg

SEQ ID NO: 433615 - DNA, 579 bp, Homo sapiens
  misc_feature: GZ8MTXP02JA1TQ.4.57.F02.1.454.CMB.2.raw
  modified_base (294)..(294): a, c, t, g, unknown or other
  modified_base (322)..(322): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacggcaggatacctgtgtggaacagcatcggaaggtaaagtgtaacagttggtacaggcagaacgccgaggccacggcccctggtggtggtcgtcgttangatagcgacccggcctgaggactcccgngacgcgtatctcgtcgctccaactcgtagggaaccaccggcccacctcgaccatcacggcgagggtacgaacggccggggatcgggacgccgtaactagttacgtgtcgagggtgtagggtattaggtaggttgtgactcagtccagttcgtcgtacggtaacgtcgggtaaccgacggttccgtccgtaccgtaccgtcaccgacccgaacggacccaaccccgagtccgtaccacgttcctccggtccccctccc

SEQ ID NO: 433616 - DNA, 862 bp, Homo sapiens
  misc_feature: GZ8MTXP02GD9EZ.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccaccctcagtgtcaggtcggccccgagggcaggaccggccaaggactaaccgtggtggtacgggaaccagctagtacgggaaggtaaaagtgtaactagttggtaacgaggacaaggaacgccgaggcccgaccggtccccgtggtcgggttcggttccggttaccgtttagtaggtaacgtacggaccggaaccccggtcccgtacggacggggtacctcccgtaggacggtcgtacttccgtcgtcccggtacctacccgtaacgttccgggtacggggaaaccctacccgggacccccgtacccgtacgtaaccccgacgtaccgaaccggacgggtaaccgggggtaacgggaaaccgggggacccgggggtaagtaccgggggaaacccggggtacccgttaaacgtttaaccggtttaccgtacggggtttaccgggtagggggtttaggggttagggggtaaagtttaaggggtttaggggttagggttacgtacggttaccttaaccgttaccgtaacgtttacccggttacggttaacccggtaagggtacccggggtaaacctaacgggtttccccgtacccggtttacgtaaccggtaccgaaccccgaacccggaaaccgaccccctaaacccggtacgttaccgaccctttaaccgtccggttacccgtttaccctacccg

SEQ ID NO: 433617 - DNA, 615 bp, Homo sapiens
  misc_feature: GZ8MTXP02FQ00X.4.57.F02.1.454.CMB.2.raw
  modified_base (296)..(296): a, c, t, g, unknown or other
  modified_base (468)..(468): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagccaccctcagtgtcaggtcggccccagggcagacggccaggataacctgtgtgggaaccagcatcggaaggtaaagtgtacattggtacaggcagaagccaggccaggcccctgtggtggtcgtcgttangatacggcgaccggccctcgagggactcccgtggacgcgattctcgtcggcctccaactcgtacgggaaccacggcccaccctgaccatcagcgacggggtcgaacggccggggatcggacggacccgtactagttacgtgtcgagggtggtagggagtaggtaggtggtanagtcactccagttacgttcgtacggaacgtcgggaaccgtaacggtcctacccggttacccgtacgtaccgaaccgaccccgaaacggaccccaaacccccgtacgtaccggtacctacccttccgtcccgttaccccctacccccg

SEQ ID NO: 433618 - DNA, 593 bp, Homo sapiens
  misc_feature: GZ8MTXP02GMR0G.4.57.F02.1.454.CMB.2.raw
  modified_base (224)..(224): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggatactgtgtggaaccngcagtcggagtaaagtgtacattggtacaggcagaagcaggccaggcccctgtggtggtcgtcgttatgatagcgaccggcctcgagggctcccgtgagcgtattcctcgtggctccaactcgtacgggaccgaccgggccacccgtcgaccatcacgacgaggggtacgaagggccggggagtggacggccgagtaacgttactgtacgtaggtggtaggggtagttaggtaggtgggtagagtcgtataccgtacgttacgtcgttacggaacggtacggtaaccgtaaggtcctaccgttaccgtacgttaccgacgtacccgaacggtacccaacgtacccacgttacgtacctacctttacccg

SEQ ID NO: 433619 - DNA, 574 bp, Homo sapiens
  misc_feature: GZ8MTXP02GCOJE.4.57.F02.1.454.CMB.2.raw
  modified_base (471)..(471): a, c, t, g, unknown or other
  modified_base (474)..(474): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtacattggtacaggcagaagccaggccaggcccctggtggtggtcgtcgttatgatagcgaccggccctcgagggactccccgtgacgcgtattccctacgtcggctcccaactcgtaggggaccaccgggcccaccccgtgacccatcagcgaggggtcgaaggccggggatggacggccgactattaccgtgtcgaggtggtagggataggtagtgggtnatnatccagtacgttcgtacggaacgtcgggacctaaggtcctccgtcctacgtacaccgtacccgaacggccctaaactcccgactcggtaccactttcccg

SEQ ID NO: 433620 - DNA, 667 bp, Homo sapiens
  misc_feature: GZ8MTXP02HUAPX.4.57.F02.1.454.CMB.2.raw
  modified_base (271)..(271): a, c, t, g, unknown or other
tcagagcactgtagcacgaccggtgctcgatttagctcgatatagttgggtttggggctgggagaggagccccaccagcactagaagtcggcggtgtttccattcggtgatcaccactgaacacagaggactcaccatggagtttgggctgagctgggttttcctcgttgctcttttaagaggtgtccagtgtcaggtgcacctgggtggaggtcggggggaggcgtggtccaggccgtggggggtccctgagactctcctgtgcagcgtntggattcgccttcagtgcctatggcatgcacgtgggtccgcaggcctccgaggcgaaggggctagggaagtggggtagctaggtttatagtgggtttagataggaaactaaaacgaaatttctattcgacgtacgtaccgtccggtaggaaacggggccgtaacttaccaacctatcccgtacccgaagtaacgtaacttaaacgtttacgaaacgtaaacaaactaattacggaaacttaccgtaacaaggtaactaacgtaaacgtagtacgtaggaacggaacgggaccgaaagggaaccgacgggtactacggttaccttaagtttacgttggtacggtacgaaaggtaaggttaaggttacggtactaaggtttcggtttacgtttaccgg

SEQ ID NO: 433621 - DNA, 627 bp, Homo sapiens
  misc_feature: GZ8MTXP02HARMF.4.57.F02.1.454.CMB.2.raw
  modified_base (268)..(268): a, c, t, g, unknown or other
  modified_base (301)..(301): a, c, t, g, unknown or other
  modified_base (374)..(374): a, c, t, g, unknown or other
  modified_base (605)..(605): a, c, t, g, unknown or other
tcagagcactgtagcacgaccggtgctcgatttagctcgatatagttgggtttgggggcctaaggaagcagcactggtggtgcctcagccatggcatggaccgttctcctcctcggcctcctctctcactgcacaggctctgtgacctcatatgtgctgactcacgccaccctcagtgtcaggtcggccccagggcagacggccaggataacctgtgtgggaaccagcagtacggaaggtaaaagtgtacagttggtacaggcagaancaggccaggcccctggtggtggtcgtccgttangatagcgaccgcctcgacgggtactccgtggacgtcgtattcgtccgtcggctaccacgtcgtacgggtaacnccggacccaccgtcgaccgactacgacggtacgaaggggtaccgaacgggccggggagtacgggacggaccgtacgtatttaacgtcgtacgtagggtcggtaggtagtaggttaggtacgggtataacgctagtaccgtagtaaccgttcgttaaccgggacgttacgggaccgtaacggtcgtacccgtacgtacgtacgacgtacccgaacgcccaaccgacgttacnccgtaactccgtacttaccccc

SEQ ID NO: 433622 - DNA, 538 bp, Homo sapiens
  misc_feature: GZ8MTXP02JPRL2.4.57.F02.1.454.CMB.2.raw
  modified_base (410)..(410): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaacctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattcctctggctccatctgggacacggccaccctgaccatcagcaggggtcgaagccggggatgaggccgacgtattacngtcaggtgtgggatagtagtggtgatcatccagtacgttcgtacggaacgtcgggacctaagggtccctccggtacgttaccgacgacgacccgaacggccctaaacgtccacgtcgtccacttcccg

SEQ ID NO: 433623 - DNA, 657 bp, Homo sapiens
  misc_feature: GZ8MTXP02GNL5E.4.57.F02.1.454.CMB.2.raw
  modified_base (222)..(222): a, c, t, g, unknown or other
  modified_base (299)..(299): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctcagtgtcagtcggccccaggcagacgcaggatactgtgaggacngcagtcggaagtaaagtgtacagttggtacaggcaagaacgccgaggccacggcccctggtggtggtcgtccgttangagtacgccgaccggcctaggacggactcccgtagacgcgtacttcctacgcggtcctaccgaacgttccgacgggaccgacccggccctacccgtcgaacccagtccgacggacgggacgggtacggaacgggccggggtatacgggaaccgtacccgtaacgttaataccggtagtacggtaggggtggtaggtaaggttaggtaggtagggtatacgtacgtactacgtacggttacgtaccggttaacggaacggtacgggaaccgtaccggttccgtacccgttaccgttaccgacgtaacccggacccgaaaccgtcccaaaccgttccacgtccgtacctctttaccccgg

SEQ ID NO: 433624 - DNA, 585 bp, Homo sapiens
  misc_feature: GZ8MTXP02F2RNY.4.57.F02.1.454.CMB.2.raw
  modified_base (300)..(300): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtggtgggaaccagcagtcgggaaggtaaaagtgtacagttaggtacaggcagaagccaggccaggcccctgtggtggtcgtcgttangatagcgaccggcctcgagggactcccgtgacgcgattctctggcctccaactctacgggaaccacggcccaccctgacccatcgagcgagggtacgaaggccgggatcgacggcgactatacgtgtcaggtgtagggataggtagtggtagatacactccagttaccgtcgttacggaacgtcggggaacctaacgggtcctccggtacctaccgtacgaccgtacccgaacggaccccaaacccctacgtcgtacctacctccgtccggtttccccacccccg

SEQ ID NO: 433625 - DNA, 722 bp, Homo sapiens
  misc_feature: GZ8MTXP02F2XVV.4.57.F02.1.454.CMB.2.raw
  modified_base (224)..(224): a, c, t, g, unknown or other
  modified_base (293)..(293): a, c, t, g, unknown or other
  modified_base (330)..(330): a, c, t, g, unknown or other
  modified_base (358)..(358): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccaggggcagacggccaggataacctgtgtgggaaccngcagtcggaaggtaaaagtgtaacattggtacaggcagaagcaggccaggccctgtggtgtcgtcgtangatgcgacggcctgagggactcccgtgacgcgattcncgtcggcctccaactcgtacggaaaccncgggcccaccgtgacctatccaggcgtagggtacgaacgggtcccgggatacggacggacccgtaatacgttaacgtcggtacgtagggggtagtaggggaaattagggtaggttggtacggtatacgtaacgttccgtaaacgttaccgggttaaccgttaccggggtaaaacggttaccgggggaaaacccgttaaaaccgggggttccccgtttaaaccccggtcccgtttaaaaccgggtcccgtaaacccgggtaaaccccccggtaaacgggaacccccccaaaaccccggtaccgttaccggttacccctaaaccggtttcccccggttacccttttaaccccccggtaaccccccc

SEQ ID NO: 433626 - DNA, 669 bp, Homo sapiens
  misc_feature: GZ8MTXP02JC2P3.4.57.F02.1.454.CMB.2.raw
  modified_base (308)..(308): a, c, t, g, unknown or other
  modified_base (650)..(650): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtcggccccgagggcaggacggccaggataactgtgtgggaaccagcagtcggaaggtaaagtgtaacagttggaacaggcaagaagccgaggccacggcccctggtggtggtcgtcgttangatagcgaccacgccctcgaggggactccccgtaggacgccgtacttccgtcgtcggcccttaccaaacgttccgtacgggggtaaaccacccgggcccctaacccctggaacccagtccgacgcggaacggggtaccggaacggggacccggggagtacggacgggacccgtaacgttaagttaccgtggtacggtagggtcgggtaggggtagtagggttagggttggtacgtatcaacgtcgtaacgttaccgtacgtaccgggtacgtacgggaacccgtaacggtccctcccggttacccgtaacgtccgaaccgaacccgaacggaccctaacccnccgtactcggtcctacccg

SEQ ID NO: 433627 - DNA, 760 bp, Homo sapiens
  misc_feature: GZ8MTXP02GKXFO.4.57.F02.1.454.CMB.2.raw
  modified_base (225)..(225): a, c, t, g, unknown or other
  modified_base (310)..(310): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggataactgtgtggaaccngcagtacggaaggtaaaagtgtaacagttggtacgaggcaagaacgccgacggccgacggccccgtggtggtggtccgtcgttangatagccgaccggccctagacgggactcccgtagacgcgtacttcccgtcgtcggtcctacctaacgttccggtacggggaacccaccgggccccctaaccccgtgaaccctagtaccgaacggtaccggtaacgggggtacccggaaacgggggcccgggggtaagtacggggacgggtaccccgtaacgttaacgtttaacgtgtaccggtaggggttcgggtaggggtaagtttaaggggtaggttacggggtagtaacgttaccaacgttaccctaaggttaacccggttacggtttaaaccggggtaaccggttaaccgggggtaaacccggttaaacgggtttccccgttaccccgggttaccgttaaccggtacccgaacccggtaaccccgaaacgggtacccctaaaccgtccctaacgtccgtaaccctaccgtttcccg

SEQ ID NO: 433628 - DNA, 724 bp, Homo sapiens
  misc_feature: GZ8MTXP02I1UOO.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcgagggactccccgtagacgcgtattccctacgtcgggcctcccaacttccgtacggggaccaccgggcccacccctgacccatccagcgaggggtccgaaacggcccgggggatcgggacggcccgaacttacgttaaccgtggtccgtaaggggttggttaggggaagttagggtaagggttggggttagaaagttccgtaagttaccccgtaaagtttacccggttaccgtttaaccgggtaaaacccggttacgggggtaaaacccccttaaacgggggtttaccccgttaccccgggttaccccgttaacccggggttacccgaaccgggtaccccccgaaaacggggtaccccctaaaaccgttacccccgaaccgtttccggtacccgtaacccttttcccccg

SEQ ID NO: 433629 - DNA, 729 bp, Homo sapiens
  misc_feature: GZ8MTXP02JHE4Y.4.57.F02.1.454.CMB.2.raw
  modified_base (205)..(205): a, c, t, g, unknown or other
  modified_base (299)..(299): a, c, t, g, unknown or other
  modified_base (302)..(302): a, c, t, g, unknown or other
  modified_base (307)..(307): a, c, t, g, unknown or other
  modified_base (336)..(336): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcgaaggggctggaagtggggtggctagttatattggtttgataggaactaacaaattcatgcagactcgtgaaggcatcacntcncaganacaattcgagaacactattgaaatctaanagtatacgaactagtctagacgtacgaccggagggaccacgggtcttagttacttaaagtttagttggtagacgaagtaaggttaaaggtggttactagttcggttaccgtttttacggaccgtaacggggttcgggggaaccggtaaccggggtaaaccccgttcggggttacccgtaaccccggttaccgttccccgttacgtaacgtcccgtttaccccgaacccggtaaacccggggtcccctaacggttcccgggttaccccgtttccccccggtcggggtacccccgtccccgttcggaccccgttacccgacgggtaacccgcccgtaaccccggttaccgggtcggggggaccctaaaccggaccggggccccgggtccccgggg

SEQ ID NO: 433630 - DNA, 670 bp, Homo sapiens
  misc_feature: GZ8MTXP02HRT18.4.57.F02.1.454.CMB.2.raw
  modified_base (387)..(387): a, c, t, g, unknown or other
tcagagcactgtagcacgaccggtgctcgattagctcgatatagttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggcctccaggcaaggggctggaatgggtgctagttatagtggtttgatggaactaacaaattctatgcagactccgtgaaggccattcaccatctcagagacaatttcgaagaacacattgaaatctaacagatacgaaacagtctagagacgccgaggacacggctgtactattattgngacgagagtagtgtactagtggttctttgaccgtaggtcggggaccgtaacggggtaacccgttcgggttacctaacccggttccgttaccccgttccgaaccggtccctttacccgaacccggtaaaccgggggtaccccctaaacgttccccgggttcccctttcccccccggttagggtcccccgtcccccgttacggcccgttacccggaacgggtaccgaacccgtaacccgtccggtccggggggaccaacccggacgggaccccgggtcccccggg

SEQ ID NO: 433631 - DNA, 528 bp, Homo sapiens
  misc_feature: GZ8MTXP02FHU7U.4.57.F02.1.454.CMB.2.raw
  modified_base (293)..(293): a, c, t, g, unknown or other
  modified_base (411)..(411): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccaggcagacggccaggataacctgtgtgggaaccagcatcggaggtaaaagtgtacattggtacaggcagaagccaggccaggcccctgtggtggtcgtccgttangatagcgaccggccctcaggggatcccctgagcgattctctcggctccaactctgggaaccacgggccacccctgaccatcagcagggtcgaagccgggggatgaggccgacattacngtcaggtgtggggatagtagtggtgatcatccatacgtctacggaactgggaccaaggtctaccgtccacgtcacgcccaaggcccaaccccactcgtcactctcgtcccctacccc

SEQ ID NO: 433632 - DNA, 680 bp, Homo sapiens
  misc_feature: GZ8MTXP02IEDLM.4.57.F02.1.454.CMB.2.raw
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggagcgtggtccagccgtgggggtccctgagactctctgtgcagcgtctggattcgcctcagtgcctatggcatgcacgtcggtccgccaggctcgaggcgaaggggctagggaagtggggtggctagttatagtgggtttgagtaggtaaacgtaaactaaatttctaagtgacgtaacgtaccgtaccggtaggtaaacggggacccgtaatacccgtaacctactacctacccgaaacgtaacgtaaacctaaacgtttacggaaacgaaacctaaaccgtaagttaacgtaaacttaaccgtaaacgtaaacgattaagaaacgtaacgtaccgttaacggaaggacggaaccggaaacggaccggaaccggtacgtacgttcttaaaaaactttcgttagtacggtacggaagtaacggttaaaggtacggtacgtagtaccggtttacgtttaaccggg

SEQ ID NO: 433633 - DNA, 588 bp, Homo sapiens
  misc_feature: GZ8MTXP02G6EBE.4.57.F02.1.454.CMB.2.raw
  modified_base (294)..(294): a, c, t, g, unknown or other
  modified_base (377)..(377): a, c, t, g, unknown or other
  modified_base (387)..(387): a, c, t, g, unknown or other
  modified_base (476)..(476): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggcaggataacctgtgtgggaacagcatcggaaggtaaagtgtacagttggtacaggcagaagccaggccaggcccctggtggtggtcgtccgttangatacgcgaccggccctcgagggactcccgtgacgcgtatctctcggcctaccgaactcgtgggaaccaccgggcccacctanaccgacctanacgacgacggtacgggaacgacggggacggtagacgggaccgacgtactagtaccgtgacgtaggtggtagtagtaaggtggtgtagancgtatacgtactcgttacgtacggtacgtacggaacgtaccgtctacccgtacttacgaccgaccgaaccggacaaccccaaccgtctacgactacgtcctaccttaccccc

SEQ ID NO: 433634 - DNA, 552 bp, Homo sapiens
  misc_feature: GZ8MTXP02FJLL5.4.57.F02.1.454.CMB.2.raw
  modified_base (297)..(297): a, c, t, g, unknown or other
  modified_base (361)..(361): a, c, t, g, unknown or other
  modified_base (448)..(448): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtcgttangatagcgaccggccctcaggggactccccgtgacgcgattcctctggctccaactcgtgggacncgggccaccgtgaccatcagcgaggggtcgaaggccggggatggacggccgactattcagtcgaggtgtagggataggtagtgggtnactcgagtccagtacgtcgttacggaacgtcggggaccaaggtcctccgtacctaccgtcgacgacccgaaggcccaaacgtcccacgtcgtaccactttcccg

SEQ ID NO: 433635 - DNA, 650 bp, Homo sapiens
  misc_feature: GZ8MTXP02FTX1K.4.57.F02.1.454.CMB.2.raw
tcagagcactgtagcacgaccggtgctcgatttagctcgatatagttgggtttggggggcctaaggaagcagcactggtggtgcctcagccatggcctggaccgttctcctcctcggcctcctctctcactgcacaggctctgtgacctcatatgtgctgactcagcccaccctcagtgtcaggtcggccccgagggcaggacggccaggataacctgtgtgggaaccagcagtcggaaggtaaaagtgtaactagttggtacagtcaagaagccaggccacggcccctggtggtggtcgtccgttatgatagcgacccggcctcgaggactcccgtgagcgattctcgtcggcctaccaactcgtagggaaccacgggcccaccgtcgaccactcagcgagggtacgaaacggccggggatcgggaacggccgtaactacttacgtcggtcgaggttggtaggggaatagggtaggttgggtagtatacgacgttaccgaacgttaccggttacgttacggaaccgtacggggtaacccaaaacgggttccctacccgttaccgttacgtaccgaccgtacccgaaccggaccccaaacccccgtgtaccggttaccaaccgtttccgttaccgttcccccgtaccccc

SEQ ID NO: 433636 - DNA, 557 bp, Homo sapiens
  misc_feature: GZ8MTXP02FSK5W.4.57.F02.1.454.CMB.2.raw
  modified_base (519)..(519): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggaggtcgggggaggcgtggtccagccgtggggggtccctgagactctcctgtgcagcgtctggattcgccttcagtgcctatggcatgcacgtgggtccgccaggctccgaggcgaaggggctggaagtggggtggctaagttatagttgggtttgaagttagggaaactaaactaaatttctatggacagtacctccggtaggaacgggcccgattccaccatcctaccagacgactaattcgaagaacactattagaatctacagatagaacagtctagagagacgagacacggctgtactattagttgngagaagtagtaagtcggtactagtcggttactttacgg

SEQ ID NO: 433637 - DNA, 668 bp, Homo sapiens
  misc_feature: GZ8MTXP02FEEEI.4.57.F02.1.454.CMB.2.raw
  modified_base (219)..(219): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctatcactgcacaggctctgtgacctcatatgtgctgactcagcccaccctcagtgtcagtcggccccagggcagacggccaggataacctgngtgggaaccagcagtcggaaggtaaaagtgtacattggtacaggcagaagccaggccaggccccctggtggtggtcgtccgttatgatacggccgaccggccctcgaggggactccccgtgagcgtattccctctggctccaaactccgtggggaccaccgggcccaccctgaccatcagcgagggtcgaagggccggggatgaggccgatattctgtcagggtgtgggataggtaggttgggtagactacgactccgtaagttaccggttacgtttaccggggaaaaccgttacgggggaaacccctaaacgggggttccccttaccccggttaccccgttaaacccgggttacccgaaccggaccccccggaaaacggggacccccctaaaacccgttaccccctaaacccgtttcgggttaccccctaaccctttttaccccccgg

SEQ ID NO: 433638 - DNA, 670 bp, Homo sapiens
  misc_feature: GZ8MTXP02IMTZB.4.57.F02.1.454.CMB.2.raw
  modified_base (253)..(253): a, c, t, g, unknown or other
  modified_base (266)..(266): a, c, t, g, unknown or other
  modified_base (279)..(279): a, c, t, g, unknown or other
  modified_base (343)..(343): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacggcaggataactgtgtggaacagcatcggagtaaagtgtacatgtacaggcagancagcaggccctgnggtgtcgtcgtangatagccgaccggcctcgaggactcccgtgagcgtatctctcggcctccaactcgtaggaaccncggcccacctgacccatccaggacgtacgggggtacgaaagggcccgggggatacgggacgggtacccgtaacgttaacgtttaccgtggtaccgtaggggttggtagggggtaagtttagggttaagggttgggttagacgttacctaacgttaccgacgtttaacgttcgtttaccggtaaacggtacggggaaacccgtaacgggttcccgttacccggttacccttaacggtaccgaccggtaacccccgaaacgggaccccctaaaaccccgtcgtacccggttaccacctttccgtttacccgttacccccttaacccccc

SEQ ID NO: 433639 - DNA, 629 bp, Homo sapiens
  misc_feature: GZ8MTXP02I6N89.4.57.F02.1.454.CMB.2.raw
  modified_base (174)..(174): a, c, t, g, unknown or other
  modified_base (214)..(214): a, c, t, g, unknown or other
  modified_base (221)..(221): a, c, t, g, unknown or other
  modified_base (321)..(321): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctnagtgtcagtcggcccaggcagacggcaggactaactgtgnggaaccngcagtcggaagtaaagtgtacagttggtacaggcaagagccaggccacggcccctgtggtgtcgtcgttatgatagcgaccggccgtcgaggacgtcccngagcgtatctctcgctccactcgtacggacgaccgccgaccctcgaccactcacgacgacggggtacgaacgggccggggacgtaggacgggacccgacgttaacgttacttcggtacgtaggtgggtagggtagtagttagggtggtgtagtacgtactaccgagttacgttcgtacggtacggtacgggtaaccgaacggttcccgtaccgtcccgttacgccgtaccgacccgtaaaccggaccccaaaccccgtacccgtacggtaccacccgttcctaccccggtttaccccttaaccccccg

SEQ ID NO: 433640 - DNA, 729 bp, Homo sapiens
  misc_feature: GZ8MTXP02G9YWE.4.57.F02.1.454.CMB.2.raw
  modified_base (299)..(299): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcgccccagggcagacgccaggataacctgtgtgggaaccagcagtcggaaggtaaaagtgtacagttggtacaggcaagagccaggccaggcccctgtggtggtcgtcgttangatagccgaccggccctcgagggtactccccgtagacgcgtattccccgtcgtcggcctaccaacttcgtacggggaccaccgggacccaaccccgtagaaccctataccgaacggaccgtacgggggtacccggaaacgggcccgggggaatacggggacgggacccgtaaacgtttaacgttaaccgtggtaccgtaaagggggttcggtaggggtaagtttaagggtaagggttcgggtaggtaacgtactaacgtacccgtaagttacccgttaccgtttacgggaaaccgttacgggggaaaccccttaaacggggtcccgttaccccggtacccgttaccggtacccgtaaccggacccccgtaaaaccggacccctaaaacccgttcccgtaaaccttcggtaccccgaacccgtttcccccg

SEQ ID NO: 433641 - DNA, 719 bp, Homo sapiens
  misc_feature: GZ8MTXP02JIKCI.4.57.F02.1.454.CMB.2.raw
  modified_base (178)..(178): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctnagtgtcagtggccccagggcaggacgccaggactaacctgtgtgggaaccagcagtcggaaggtaaagtgtacagttggtacaggcagaagccgaggccacggcccctggtggtcgtcgtccgttatgatagccgaccggccctacgagggactcccgtgacgcgtattccccgtcgtggccttaccgaacgttccggtacggggaacccgacccgggccccctaaacccccgttacggaacccctaactacccgaacgggtaccggaacgggggttaacccggaaaacggggcccgggggaattaccggggaacgggtaccccggaactttaacgtttaccgtggttaccgaaggggttgggttaggggaagtttagggtaagggttcgggtagaacttccgaagttaccaacgttaaccgttcggttaacggaaaccggttacggggaaacgtacgggtcccttacccgttaccgtaccgtaccaaccggtacccgaacggaccctaaaccctcaaccgttcgtacctaccgtttcccg

SEQ ID NO: 433642 - DNA, 635 bp, Homo sapiens
  misc_feature: GZ8MTXP02HDOXS.4.57.F02.1.454.CMB.2.raw
  modified_base (213)..(213): a, c, t, g, unknown or other
  modified_base (220)..(220): a, c, t, g, unknown or other
  modified_base (292)..(292): a, c, t, g, unknown or other
  modified_base (369)..(369): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacggccaggatacctgtgnggaaccngcatcggaaggtaaagtgtacattggtacaggcagaagccaggccacggcccctggtggtggtcgtcgttangataggccgaccgcctcgagggactccccgtgacgcgtattccgtcgtccggcctaccaaactcgtacgggaaaccncggccctacctgaccatccgaagcgaaggggtcgaaacggcccgggggtaatcgggaacggacccgtaattaacgttacgtcggtacgtagggtggtaggggtagttagggtagggttggtacgtagtactaacttccgaacgttaccgtcgttacgggtaacgtcgggtaaccgtaaggtcccgttccgtacctacggtccaaccgtacccaaccggtaccccaaccccgataccgcctactccgttacccgttaccccaccccc

SEQ ID NO: 433643 - DNA, 617 bp, Homo sapiens
  misc_feature: GZ8MTXP02J1O8I.4.57.F02.1.454.CMB.2.raw
  modified_base (359)..(359): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccagcagtcggaaggtaaaagtgtacattggtacaggcagaagccaggccaggcccctgtggtggtcgtccgttatgatagcgaccggccctcagggatccctgagcgattctctcggcctccaactctcgggaacncgggcccaccctgacccagtcagcgagggtcgaaacggccggggatggacggccgactattacgtgtcgagggtggtagggattaggtaggtggtagagtcatccgaagttaccggttcttaccgggaactacggggaaccctaacgggtcctcccggtcccgtaaacggtccaacgacccccgaaaacgggacccccaaaccccccgtaacgtccggtacctaacccgttccgtacccggttttcccccccgtcccc

SEQ ID NO: 433644 - DNA, 662 bp, Homo sapiens
  misc_feature: GZ8MTXP02HFOLR.4.57.F02.1.454.CMB.2.raw
  modified_base (373)..(373): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcaggacggccaggataacctgtgtgggaaccagcagtcggaaggtaaaagtgtaacagttggtacaggcaagaagccaggccacggcccctgtggtggtcgtcgttatgatgcgaccggcctcgagggactcccgtgacgcgtattcccgtctcggctaccactcgtcgggaccnccgggccacctgaccagtcagcacggggtacgaacggccgggggatcgggacggaccgtaacttacgttacgtgtacggagggttggtagggagttaggtagggttgggtagacgttacacgtaccgtaagttaccggttccgtttacgggaaacccggttacggggtaaaccccgtaaagggttccccgttacccgttacccgttaacgttacccgaaccggtacccccgaaacgggacccctaaacccgtacccgtaacgttaccggtacccacccgttttccccgg

SEQ ID NO: 433645 - DNA, 654 bp, Homo sapiens
  misc_feature: GZ8MTXP02JQ2EK.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggaccggccaggataacctgtgtagggaaccagcagtcggaaggtaaaagtgtacagttggtacaggcagaagccaggccacggccccgtgtggtggtcgtccgttatgatagcgaccggcctcgaggactcccgtgagcgtattcctcgtcgctaccaactcgtagggaccacgggcccaccgtcgaccatcgacgcgagggtacgaacggccgggggtatcggacggacccgtacgttaacgttaaccgtgtaccgaaggggttggtaggggtagttaaggtaggttgggtagacttacgacgttaccaagtttaccgttacgtttaccggggaaacgttacggggaacccgtaaagggttcccgttacccggtacccgttaccgtaccgaaccggaccccgaaacgggtcccctaaaaccgtcccaacgttcggtacctaccgtttccccgg

SEQ ID NO: 433646 - DNA, 616 bp, Homo sapiens
  misc_feature: GZ8MTXP02JYFKR.4.57.F02.1.454.CMB.2.raw
  modified_base (228)..(228): a, c, t, g, unknown or other
  modified_base (374)..(374): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcagtcggaaggtaaagtgtacattggtacaggcagaagccaggccaggcccctgtaggtggtcgtccgttatgataggcgaccggccctgacgggactcccgtgacgcgtattcccgtctggtctaccgaactccgtagggaccnccgggacccacccgtacgacccagtacacgccgaggggtaccgaaacgggcccgggggatcgggacggccggtaactacgttaccgtgtacgagggtggtagggagtaggtagtgggtagatcgattcccagttaccgtcgttacggtaacgtcggggaaccctaggtaccctcccgtaccgttaccgaccgacgacccgaacggaccccaaaccttcccaacgttcggaaccacctttccc

SEQ ID NO: 433647 - DNA, 653 bp, Homo sapiens
  misc_feature: GZ8MTXP02G6NGQ.4.57.F02.1.454.CMB.2.raw
  modified_base (302)..(302): a, c, t, g, unknown or other
  modified_base (346)..(346): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtaacctcatatgtgctgactcagcccaccctcagtgtcagtcggccccagggcagacggccaggataacctgtgtaggaaccagcagtcggaaggtaaaagtgtaacagttggacaggcagaacgccaggccacggcccctggtggtggtcgtccgttangagtacgcgaccggccctcgagggactcccgtgacgcgtattcncgtggccctaccaactcgtacgggaacaccggacccacccgtcgaacctactaccgacggcgaacgggggtaccgggaaacgggcccgggggtaagtacgggaaccgggacccgtaaacgtttacgttaacgtcggtacggtagggtggtagggtaataggtaggtggtagatacactcctaagttacgttcgtacggaacgtacgggaaccgtaacggttcctccgttacctaaccgcgaaccgacccgaaaccgaccccaaacccgaacgtcgtacctactccgtccgtcccccgtaccttcccc

SEQ ID NO: 433648 - DNA, 642 bp, Homo sapiens
  misc_feature: GZ8MTXP02G4R92.4.57.F02.1.454.CMB.2.raw
  modified_base (224)..(224): a, c, t, g, unknown or other
  modified_base (295)..(295): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggccaggataacctgtgtgggaaccngcagtcggaaggtaaagtgtacattggtacaggcagaagccaggccaggcccctgtggtggtcgtcgttangatgcgaccggcctcgagggtactcccgtgacgcgtattcctcgtgggtccctaccgaactcgtacggggaaccacgggcccaccctggacccatcgaggcgaacggggtcgaaaggcccgggggaatcgggacgggcccaacgttagttacgtggtaccgaggggtggtagggtattaggtaggttgggtagtagtcaacgtaccgtagttacggttcgtacgggtaaacggtcgggaacccgtaaaggttcccttccggtaccctacggtaccgacgaccccgaacggtacccccaaaccccgtcgttacgtaccctaccttccttccgttacccctaacccccg

SEQ ID NO: 433649 - DNA, 643 bp, Homo sapiens
  misc_feature: GZ8MTXP02IZ5PN.4.57.F02.1.454.CMB.2.raw
  modified_base (181)..(181): a, c, t, g, unknown or other
  modified_base (218)..(218): a, c, t, g, unknown or other
  modified_base (225)..(225): a, c, t, g, unknown or other
  modified_base (300)..(300): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtntcagtcggccccagggcagacggcaggatacctgtgnggaaccngcagtcggaaggtaaatgtacagttggacaggcaagacgccaggccacggccccgtgtggtggtcgtccgttagngatacggccgaccggcccacgagggactcccgtgacgcgtacttccgtcgtcggcctacccgaacgtccgtacggggaccacccgggaccccaccccgtgaaccccatccgaagccgtaaggggaccggaacgggacccgggggattacggaaacggtcccgtaacttacgttacgtaggtcgtaagggttggtaggggtaattacggtagggttacgggtagtacttacgaacttcccgaaagtccggttacgttacgggaacgttacgggaaccgtacggtccctaccggtactacgtacaccgaccgaacggcccaacgttcccagtctaccacttcccg

SEQ ID NO: 433650 - DNA, 633 bp, Homo sapiens
  misc_feature: GZ8MTXP02ID3TM.4.57.F02.1.454.CMB.2.raw
  modified_base (374)..(374): a, c, t, g, unknown or other
  modified_base (490)..(490): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgccgactcagccaccctccagtgtcagtggccccgacggacagacggccgaggaagtaacctgtggtagggaaccgagcgagtacggaaggtaaaggtgtacagtggtacgaggcgagaagccacggccacggcccgtgtggtggtcgtccgttagtgatagcgccgcctcgagggactcctgagcgtatctccgtgctaccactcgtcggaacnccggcccacctcgaccactcgacgcgacggggtacggaaacggcccggggatacggacggaccgtactagttacgtgtacgaggtgggtaggagttagtaggtggtagatacgtanaccgtacgtacggttccgtttaccggaaacgtcgggtaacccgaaacggttcccgtacccgttcccgttaaacgtcccggaacgacccccgaaaggcccctaaaccgtcccaccgttacgtccaaccgtttccttacccccgg

SEQ ID NO: 433651 - DNA, 672 bp, Homo sapiens
  misc_feature: GZ8MTXP02IDVAC.4.57.F02.1.454.CMB.2.raw
  modified_base (206)..(206): a, c, t, g, unknown or other
  modified_base (422)..(422): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccnccaggcctccgaggcaagggggctgggaatggggtggcagttatagtggtttgataggaactaaacaaattctaatgcagactccgtagaacggcctattccaacctatcctaccagacgtaactaagtttcgaaagaaacactatttagaaactctaacgagatacgaaactagtctaggaagacgccgaggacacggcttagtcttattattgngacgagtagtaagtggtactagttacggttctttacggaccgtagggtcggggaccgtaacggggtaacccttcgggtacctaccggttcctcccgttcgacgttccttacccgaaccgtaacgggtccctacgttcccggtttcccgttcccccggtcgggcccctccccgtcgtacccgttcccggaacgaccgtaaccgtacccggttccggcgggggacctaccggacggtacccgggtccccggg

SEQ ID NO: 433652 - DNA, 662 bp, Homo sapiens
  misc_feature: GZ8MTXP02JIIUQ.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccgaggcgaagggggctggaagtggggtggctaagttatagttggtttgataggaaactaactaaattctaatgacagacctccggtgaaggccgtattcaccatctccaagagactaatttcgaagaaacactattagaaactctaacagtatacgaacagttcagagacgacgagggacacggtctagttacttaatttagttggtgtacggtaagtaaggtaaggtggtacgtagttcgggtttccgttttacggaaccgtagggttcggggaccgtaccggggtaacccgttcggtaccgtacccggtcctccgtacgacgtccttacccgaaccgaccggtcccacgttccggtccccttccccgtccggcccgtcccgtcgcccgtaccgacggtacgaacccgtccgttccggcggggaccaccggtacggcccggtcccgg

SEQ ID NO: 433653 - DNA, 718 bp, Homo sapiens
  misc_feature: GZ8MTXP02FUXMM.4.57.F02.1.454.CMB.2.raw
  modified_base (334)..(334): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccgagggcagacggccagatacctgtgtggaaccagcagtacggaaggtaaagtgtactagttggtacaggacagaagccgaggccacggccccgtggtcggtggtccgtccgttatgatacgcgaccggccctcgaggactcccgngacgcgtattccgtcgtcgtcctaccaacgtcggtacgggaaaccctcccggggccccctaacccgtacgaaccctacgtaccgaacggaccgggaacgggggttaccggaaacggggaccccgggggtagtacggggaccgggtacccgttaaacgtacgtttaaccgtcggggttacgacggggttggtaggggtaagttaagggttcggttaggggtataactacgtaacgttccgtaagtttaccggttacgttaaccgggaacgtacggggaaccctaacgggttccctcccggttaccgtacgtaccgaacccgtacccgaaccggacccccaacccgtacgtcgttacccacgtttcctacccgtaccccttacccc

SEQ ID NO: 433654 - DNA, 591 bp, Homo sapiens
  misc_feature: GZ8MTXP02F8VBP.4.57.F02.1.454.CMB.2.raw
  modified_base (210)..(210): a, c, t, g, unknown or other
  modified_base (402)..(402): a, c, t, g, unknown or other
  modified_base (417)..(417): a, c, t, g, unknown or other
  modified_base (431)..(431): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcacgtgggtccnccaggctccgaggcgaaggggctgggaagtggggtgctagttatagtggtttgataggaactaaacaaattctaatgcagactccgtagaagggccgattcaccatctccagagactaatttcgaagaacacattagaaatctaacagtatgaaacagtctagagagccgagacacgactgtactatattgngacagagtaagtgtnatcggtctttgacngtagggcagggtaaccgtgctaccgtctcgtcacgtctaccacgaacggcccacgtccggtacccttccccgcggtccccgtcccgttcgccctacccgtacgggaaccgtaccgaaccgttccggtaccgggggtacctaaccggtacgtcccccgggg

SEQ ID NO: 433655 - DNA, 786 bp, Homo sapiens
  misc_feature: GZ8MTXP02GIADR.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctcagtgtcaggtcggccccagggcaggacggccaaggatacctggtgtacgggaaccagcagtacggaaggtaaagtgtactagttgggtacaggcaagaacgccgaaggccgacggccccgtggtgggtcggttccgtccgttatgacgtacggccggacccggccctacgacggggtactcccgtgagcgtattcccgtcgtcggctacctaacgtccgttacggggaacctccgggccccaacccgtcgaacccgtacgtaccggaacggtaccgggacgggggttacccgggaaacgggggtacccgggggtaagacggggaacggggaccccgtaaacgtttaacgttaaccgttcgggtaccggtaagggggttaggtggggtaacgtttagggtagggttaggggttacggacttacgtacgttcccgtaaaacggtttcccggttacgggttacccggtaaaaccgggttcggggtaaaaccccgtttaaacggggttccccgttacccggtacccgttaacccggttccgaacccggacccgaaacggtacccctaaaaccgttcccggtaaccgtcttaacccggtacctttcccccgg

SEQ ID NO: 433656 - DNA, 568 bp, Homo sapiens
  misc_feature: GZ8MTXP02GNQN8.4.57.F02.1.454.CMB.2.raw
  modified_base (337)..(337): a, c, t, g, unknown or other
  modified_base (354)..(354): a, c, t, g, unknown or other
  modified_base (364)..(364): a, c, t, g, unknown or other
  modified_base (433)..(433): a, c, t, g, unknown or other
  modified_base (460)..(460): a, c, t, g, unknown or other
  modified_base (527)..(527): a, c, t, g, unknown or other
  modified_base (538)..(538): a, c, t, g, unknown or other
tcagagcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcacgtgggtccgccaggcctccgagggcgaagggggctgggaagtggggtgctagttatagtggtttagataggaactaaacaaattcatgcagactcggtagaagggccattcaccatcctcaagagaactaatttcgaanaacactattagaatcanagatagaacngtcaggagacgcgagacacggctagtctattagtgtgacgagagtagtgtacagttcgttcttagacgnggtcgggaccacgggtacctggtaccnccgtctcctcgacgtccctaccaacgaccggtccctagtcccggttccctccccgtgcccgtcccgntccgccgagcnccgtctcgggtcggacacgcggccgtccgg

SEQ ID NO: 433657 - DNA, 615 bp, Homo sapiens
  misc_feature: GZ8MTXP02I0Y60.4.57.F02.1.454.CMB.2.raw
  modified_base (382)..(382): a, c, t, g, unknown or other
  modified_base (415)..(415): a, c, t, g, unknown or other
  modified_base (431)..(431): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtcgggtccgccaggctccgagggcaagggggctagggaagtggggtgctagttatagttggtttgataggaaactaaactaaattctaatgacagactccgtggaaacgggcccgtattcaccatcctaccagacgaactaattcgaagaacactattagaactctacagtatacgaactagtntagagacgcgagacacggctgtactattagtgngacgtagagtagtgtntagtcgttcttagacgtaggcgggaccgacgggtacctcggtactaccgtctcccgtcgacgtcctccgaaccgacggtaccctagtcccggttccctccccgtcggcccgtcccgtcgtaccgtccgaacggccgtccgtaccggtcggtacgggggcctaacggccgggtaccggtcccggg

SEQ ID NO: 433658 - DNA, 605 bp, Homo sapiens
  misc_feature: GZ8MTXP02HJ9BE.4.57.F02.1.454.CMB.2.raw
  modified_base (178)..(178): a, c, t, g, unknown or other
  modified_base (337)..(337): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgccaccctnagtgtcagtcggccccagggcagacggcaggactaacgtgtgagggaaccagcagtacggaaggtaaaagtgtacagttggacaggacagaacgccgaggccgacggcccctggtggtggtcgtccgtatgatacgcgaccggcctcgaggactcccgnggacgcgtactccgtagtcgctaccaacgtcgacgggaccaccggacccacctcgaacctagcgagacgaggggacggaaacgggccggggagtacgggacggaccgtaaccttagttaaccgtgtacgagggtggtagggtagttaaggtggtaggtagagtcactacacgtaaccgttcgttacggaacgtcggaaccgtacggtcctccgtaccgtacggcacggacccgaacggacccaaccgtcacgtcgtacctacttcccg

SEQ ID NO: 433659 - DNA, 575 bp, Homo sapiens
  misc_feature: GZ8MTXP02F526K.4.57.F02.1.454.CMB.2.raw
  modified_base (205)..(205): a, c, t, g, unknown or other
  modified_base (384)..(384): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaaggggctggaatgggtggcagttatagtggtttgatggaactaacaaattctatgcagactcgtgaaggccattcacatctccagagacaatttcgaagaacactattgaaatctacagatgaacagtctagagacgcgaggacacggctgtcttattattgtgngagagtaagtgtctagtcggttctttacgaccgaggtcgggaccgaacgggtaccgtcggtcaccgtcgtcctcacgtccttacccaaccgacggccacgttccggttcccttccccgtcggcccgtcccgtcgtcctacccgaggtaccgccgtacccgtcggtcgggggccaccgacggccggtcccgg

SEQ ID NO: 433660 - DNA, 718 bp, Homo sapiens
  misc_feature: GZ8MTXP02J22GR.4.57.F02.1.454.CMB.2.raw
  modified_base (174)..(174): a, c, t, g, unknown or other
  modified_base (222)..(222): a, c, t, g, unknown or other
  modified_base (295)..(295): a, c, t, g, unknown or other
  modified_base (378)..(378): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctnagtgtcagtcggcccagggcaggacgcaggactaacgtgtgaggaacngcagtcggaaggtaaagtgtacagttggtacaggcagaacgccaggccaggccctggtggtcgtcgtcgttangatacggcgaccggcctgacgggactccgtaggacgtccgtacttctcgtccggacctaccgaaccgtcgtacgggaaacccncggggcccccaaccgtcgaaccctagtaccgaaggtaccgagggggtacccgaaacggggacccgggggatacggggaaccgggcccgtaacgttaacgttacggttcggtaccgggtaggggttcgggtagggggtaattagggtagggtgggttagaagtttccaacgtacctaagttaccgttacggttaccgggtaacgtacgggggaaccgttaacgggtcccgtacccgtacccggttaaacgtccgaaccggaaccccgtaaaccgggacccccaaaaccccgtcgttaccggtaccctaacccggtccttacccggtttaccccaacccccg

SEQ ID NO: 433661 - DNA, 634 bp, Homo sapiens
  misc_feature: GZ8MTXP02F2BQ8.4.57.F02.1.454.CMB.2.raw
  modified_base (298)..(298): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcaggtcggccccagggcagacggccaggataacctgtgtgggaaccagcagtcggaaggtaaaagtgtaacagttggtacaggcagagccaggccaggcccctgtggtggtcgtcgttangatgcgaccggcctcgagggactcccgtgacgcgtattctcgtcggcctaccaactcgtacgggaaccaccggcccaccctcggaaccactcaacggcgaaggggtaccgaaacgggcccgggggatcgggaacggcccgtaacttagttacgtcggtacgaggggttggtacggggtaagttagggttaggtgggtataacgtcaactccgtaattccgttacgttacggaaacgtcggggaacctaacggtcctaccgtaccgtaccgtacgaccgacccaacggaccccaaacccgaagtacgtacctaaccttcctccgtaccccctacccg
